United States Patent 11,931,406 (FLAVIVIRUS VACCINE) - sequence listing, part 21

SEQ ID NO: 9500 - RNA, 9876 nt, Artificial Sequence
  derived and/or modified CDS sequence (opt1) from DENV-2__EU482448__SS-prME
agcgccgggaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacgaccgagugcccgaacaccaaccgcgcguggaacagccuggagguggaggacuacggguucggcgucuucaccacgaacaucuggcucaagcugaaggagaagcaggacgccuucugcgacuccaagcugaugagcgccgccaucaaggacaaccgggccgugcacgcggacaugggguacuggaucgaguccgcccucaacgacaccuggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgccggccccuggcaccuggggaagcuggagauggacuucgacuucugcgacggcaccacggugaucgucaccgaggacugcgggaaccggggccccucccuccgcaccaccacggcgagcggcaagcugaucaccgaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacgcgcguggggaccaagcacgccauccuccuggucgcgguguccuucgugacccugaucaccggcaacaugagcuucaaggaccucgggcgggucguggugauggucggcgccacgauggccgacgacaucgggaugggcgugaccuaccuggcccugcucgccgcguucaaggugcgccccaccuucgccgccggccugcugcuccggaagcugaccuccaaggagcugaugaugacgaccaucgggaucguccuccugagccaguccaccauccccgagaccgugcuggagcucacggacgcccuggcccugggcaugauggugcucaagaucguccgcaacauggagaaguaccagcuggcggugaccaucauggccauccugugcgucccgaacgccgugauccuccagaacgccuggaaggugagcugcaccauccuggccgucguguccgugagcccccugcuccugaccuccagccagcagaagacggacuggaucccccuggcgcucaccaucaaggggcugaaccccaccgccaucuuccugaccacgcucucccgcaccaacaagaagcggagcuggccgcugaacgaggccaucauggccgucggcaugguguccauccuggcgagcucccuccugaagaacgacauccccaugaccggcccccugguggccgggggccuccugaccgucugcuacgugcugacggggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacccucacgauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguacaaggaggggaccuuccacaccauguggcacgugacgcggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgcuccggcgccuacgugagcgccaucgcccagaccgagaaguccaucgaggacaaccccgagaucgaggacgacaucuuccggaagcgccggcugacgaucauggaccugcaccccggggcgggcaagaccaagcgcuaccuccccgccaucgugcgggaggccaucaagcgcgggcugcggacccugauccucgccccgacccgcgucguggcggccgagauggaggaggcccugcggggccugcccauccgcuaccagacgcccgccauccgggccgagcacaccgggcgcgagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggcgaggcggccgggaucuucaugaccgccacgccgcccggcagccgcgacccguucccccaguccaacgcccccaucaucgacgaggagcgggagauccccgagcgcagcuggaacacggggcacgagugggucaccgacuucaagggcaagaccgugugguucgugccguccaucaaggccgggaacgacaucgcggccugccugcggaagaacggcaagaaggucauccagcugagccgcaagaccuucgacuccgaguacgugaagacgcggaccaacgacugggacuucguggucaccaccgacaucagcgagaugggcgccaacuucaaggccgagcgcgugaucgacccccggcgcugcaugaagcccgugauccucacggacggggaggagcgggucauccuggcgggccccaugccggugacccacuccagcgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgcgagaagguggacgcgaucgacggcgaguaccggcugcgcggggaggcccgcaagaccuucgucgaccucaugcggcgcggcgaccugcccguguggcuggccuacaagguggccgccgaggggaucaacuacgcggaccggcgcuggugcuucgacggcaucaagaacaaccagauccucgaggagaacgucgagguggagaucuggacgaaggagggggagcggaagaagcugaagccgcgcuggcuggacgcccggaucuacagcgacccccucgcccugaaggaguucaaggaguucgccgccggccgcaagucccugacccucaaccugaucaccgagaugggccggcugcccaccuucaugacgcagaagacccgcgacgcgcucgacaaccuggccguccugcacaccgccgaggccgggggccgggcguacaaccacgcccucagcgagcugcccgagacccuggagacgcuccugcugcucacccugcuggccaccgugaccgggggcaucuuccucuuccugauguccggccgcgggaucggcaagaugacccuggggaugugcugcaucaucacggccagcauccuccugugguacgcccagauccagccgcacuggaucgcggccuccaucauccuggaguucuuccucaucgugcugcugauccccgagcccgagaagcagcggacgccccaggacaaccagcucaccuacgucgugaucgccauccugaccguggucgccgccacgauggcgaacgagaugggcuuccuggagaagaccaagaaggaccucgggcugggcagcaucgccacccagcagccggaguccaacauccuggacaucgaccuccgccccgccagcgccuggacccuguacgccguggcgacgaccuucgugacccccaugcugcggcacuccaucgagaacagcagcgucaacgugucccucaccgccaucgccaaccaggccacggugcugaugggccuggggaagggcuggccccucagcaagauggacaucggggucccgcugcuggccaucggcugcuacucccaggugaaccccaucacccucaccgcggcccugcugcuccugguggcccacuacgccaucaucgggcccggccugcaggcgaaggccacccgcgaggcccagaagcgggccgccgcgggcaucaugaagaaccccacggucgacgggaucaccgugaucgaccucgacccgauccccuacgaccccaaguucgagaagcagcugggccaggugaugcugcucauccugugcgucacccaggugcugaugaugcgcaccacgugggcccucugcgaggcccugacccuggccaccgggcccaucagcacccucugggagggcaacccggggcgguucuggaacacgaccaucgccguguccauggcgaacaucuuccgcggcagcuaccuggccggcgccgggcuccucuucuccaucaugaagaacaccaccaacacgcggcgcggcaccgggaacaucggcgagacccugggcgagaaguggaagucccgccugaacgcccucgggaaguccgaguuccagaucuacaagaaguccggcauccaggaggucgaccggacccuggccaaggaggggaucaagcgcggcgagacggaccaccacgcggugucccgggggagcgccaagcugcgcugguucguggagcggaacauggucacccccgagggcaaggugguggaccucggcugcgggcgcggcgggugguccuacuacugcggcgggcugaagaacguccgggaggugaagggccugaccaagggcgggcccggccacgaggagcccaucccgaugagcaccuacggguggaaccucgugcgccugcaguccggcgucgacguguucuucaucccgcccgagaagugcgacacgcugcucugcgacaucggggagagcucccccaacccgaccguggaggccggccggacccugcgcguccugaaccucguggagaacuggcugaacaacaacacccaguucugcaucaaggugcugaaccccuacaugcccagcgucaucgagaagauggaggcccugcagcggaaguacggcggggcgcucgugcgcaacccgcugucccggaacagcacccacgagauguacugggugagcaacgccuccggcaacaucgucagcuccgugaacaugaucagccgcaugcugaucaaccgguucacgaugcgccacaagaaggccaccuacgagcccgacguggaccucggguccggcacccggaacaucgggaucgagagcgagauccccaaccuggacaucaucggcaagcgcaucgagaagaucaagcaggagcacgagaucuccuggcacuacgaccaggaccaccccuacaagaccugggccuaccacggcagcuacgagacgaagcagaccggguccgccagcuccauggucaacggcguggugcggcugcucaccaagccgugggacguccugcccaccgugacgcagauggcgaugaccgacaccacccccuucgggcagcagcgcguguucaaggagaaggucgacacgcgcacccaggagcccaaggagggcaccaagaagcugaugaagaucaccgccgaguggcucuggaaggagcugggcaagaagaagacgccgcggaugugcacccgcgaggaguucacccggaaggugcgcagcaacgccgcccugggggccaucuucaccgacgagaacaaguggaaguccgcgcgggaggccguggaggacagccgcuucugggagcucgucgacaaggagcggaaccugcaccuggagggcaagugcgagacgugcguguacaacaugauggggaagcgcgagaagaagcucggcgaguucgggaaggccaagggcucccgggccaucugguacauguggcugggcgcccgcuuccuggaguucgaggcgcucggguuccugaacgaggaccacugguucagccgggagaacucccugagcggcgucgagggggagggccuccacaagcugggguacauccugcgcgacguguccaagaaggagggcggcgccauguacgccgacgacaccgccgggugggacacccggaucacccucgaggaccugaagaacgaggagauggugacgaaccacauggagggcgagcacaagaagcuggcggaggccaucuucaagcucaccuaccagaacaaggucgugcgcgugcagcggcccacgccccgggggaccgucauggacaucaucagccggcgcgaccagcggggcagcggccagguggggacguacggccugaacaccuucaccaacauggaggcccagcugauccgccagauggagggggagggcguguucaagaacauccagcaccucaccgucacggaggagguggccgugcagaacuggcuggcccgggucgggcgcgagcgccugucccggauggcgaucagcggcgacgacugcguggugaagccccucgacgaccgcuucgccaacgcccugaccgcccugaacgacaugggcaagauccggaaggacauccagcagugggagccguccaagggguggaacgacuggacccagguccccuucugcagccaccacuuccacgagcucaucaugaaggacggccgcgugcuggugguccccugccggaaccaggacgagcugaucgggcgcgcccggaucucccagggcgcgggguggagccuccgcgagaccgccugccugggcaaguccuacgcccagauguggagccugauguacuuccaccggcgcgaccuccggcuggccgccaacgcgaucugcuccgccgugcccagccacugggugccgacgucccgcaccaccuggagcauccacgccaagcacgaguggaugaccaccgaggacaugcugacggucuggaaccggguguggauccgcgagaaccccuggauggaggacaagacccccguggaguccugggaggagauccccuaccucggcaagcgggaggaccaguggugcgggagccugaucggccugaccucccgcgccaccugggccaagaacauccaggcggccaucaaccagguccggagccucaucgggaacgaggaguacacggacuacaugccguccaugaagcgcuuccggcgcgaggaggaggaggccggcgugcugugguga

SEQ ID NO: 9501 - RNA, 9876 nt, Artificial Sequence
  derived and/or modified CDS sequence (opt1) from DENV-2__EU482449__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacacgaucaccuacaagugcccccuccugcgccagaacgagcccgaggacaucgacugcuggugcaacagcaccagcaccugggugacguacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagacguggauccugcgccaccccggcuucaccaucauggcggccauccuggccuacaccaucgggaccacgcacuuccagcgggcccucaucuucauccugcugaccgcggucgcccccagcaugaccaugcgcugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccgcaaguacugcaucgaggcgaagcugacgaacaccaccaccgagucccggugcccgacgcagggcgagcccagccugaacgaggagcaggacaagcgcuucgucugcaagcacuccaugguggaccggggcugggggaacggcugcgggcuguucggcaagggcgggaucgugaccugcgccauguucacgugcaagaagaacauggagggcaagaucguccagcccgagaaccuggaguacaccaucgugaucacgccccacagcggggaggagcacgccgugggcaacgacaccgggaagcacggcaaggagaucaagaucaccccgcaguccagcaacaccgaggccgagcugaccggguacggcacggucaccauggagugcagcccccgcaccggccucgacuucaacgagauggugcugcugcagauggaggacaaggccuggcucgugcaccggcagugguuccuggaccugccccuccccuggcugccgggggcggacacccagggcagcaacuggauccagaaggagacgcuggucaccuucaagaacccccacgccaagaagcaggacguggugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgcggagacccagcacgggacgaucgucauccgcgugcaguacgagggcgacggcucccccugcaagauccccuucgagaucauggaccuggagaagcggcacgugcucgggcgccugaucaccgucaacccgaucgugaccgagaaggacagccccgugaacaucgaggccgagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcgcuccaccagguguucggggccaucuacggcgccgccuucagcggggucuccuggaccaugaagauccugaucggcgcgaucaucacguggaucgggaugaacagccgcuccaccagccuguccgugagccuggugcucgucggcgugaucacccuguaccugggggccauggugcaggccgacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcgcacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggccaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgagaagcaggacguguucugcgacuccaagcugaugagcgcggccaucaaggacaaccgggccgugcacgccgacaugggcuacuggaucgaguccgcccucaacgacaccuggaagauggagaaggcgagcuucaucgaggucaaguccugccacuggcccaagagccacacccugugguccaacggcgugcuggagagcgagaugaucauccccaaguccuucgccgggcccgugagccagcacaacuaccgcccgggcuacuacacccagacggccgggcccuggcaccucggcaagcuggagauggacuucgacuucugcgaggggaccaccgucguggugaccgaggacugcggcaaccggggccccagccugcgcacgaccaccgccuccgggaagcucaucaccgaguggugcugccggagcugcacgcugcccccgcugcgcuaccggggcgaggacgggugcugguacggcauggagauccgcccccucaaggagaaggaggagaaccuggucaacucccuggugaccgcggggcacggccagaucgacaacuucagccucggcgugcuggggauggcccuguuccucgaggagaugcugcggacccgcgucggcaccaagcacgccauccugcucguggccguguccuucaugacgcugaucaccgggaacaugagcuuccgggaccugggccgcgucauggugauggugggggccaccaugaccgacgacaucggcaugggcgucacguaccucgcgcugcuggccgccuucaaggugcgccccaccuucgccgccgggcuccugcugcggaagcucaccuccaaggagcugaugauggcgaccaucggcaucgcccugcucagccaguccacgauccccgagaccauccuggagcugaccgacgcccucgcccuggggaugauggugcugaagaucguccgcaacauggagaaguaccagcucgccgugaccaucauggcgaucagcugcgugccgaacgccgucauccugcagaacgccuggaagguguccugcacgauccuggccgcggugagcgucagcccccuccugcugaccagcucccagcagaaggccgacuggaucccccucgcccugaccaucaagggccugaaccccaccgccaucuuccucacgacccugagccggaccuccaagaagcgcagcuggccgcugaacgaggccaucauggcggugggcaugguguccauccucgccagcagccugcugaagaacgacauccccaugaccgggccccucgucgccggcgggcugcugacggugugcuacguccucaccggccgguccgccgaccuggagcuggagcgcgccaccgacgugaagugggaggaccaggcggagaucagcggguccagccccauccucuccaucaccaucagcgaggacggcuccaugagcaucaagaacgaggaggaggagcagacgcugaccauccugauccggaccggccuccuggugaucuccgggcuguucccggucagcauccccaucaccgccgccgccugguaccucugggaggugaagaagcagcgcgccggcgugcugugggacguccccagcccgccgcccguggggaaggcggagcuggaggacggcgccuaccggaucaagcagaaggggauccucggcuacagccagaucggcgccgggguguacaaggagggcaccuuccacacgauguggcacgucacccgcggggccgugcugaugcaccggggcaagcgcaucgagcccuccugggccgacgugaagaaggaccugaucagcuacgggggcggcuggaagcucgagggggaguggaaggagggcgaggagguccaggugcuggcgcuggagcccgggaagaacccccgggccgugcagaccaagcccggccucuucaagaccaacacggggaccaucggcgccgucucccuggacuucagccccggcaccuccgggagccccaucguggaccgcaagggcaagguggucgggcuguacggcaacggcguggugacccgguccggggccuacgucagcgcgaucgcccagacggagaaguccaucgaggacaaccccgagaucgaggacgacaucuuccgcaagaagcggcucaccaucauggaccugcaccccggcgccgggaagaccaagcgcuaccugcccgccaucgugcgggaggccaucaagcgcggccugcggacccucauccuggcgccgacgcgcguggucgccgccgagauggaggaggcccugcgcgggcuccccauccgguaccagacccccgccauccgcgcggagcacaccggccgggagaucguggaccugaugugccacgccaccuucacgaugcgccugcucucccccgugcgggucccgaacuacaaccugaucaucauggacgaggcccacuucaccgaccccgccagcaucgccgcgcgcggcuacaucuccacccggguggagaugggggaggccgccggcaucuucaugaccgccacgccgcccgggagccgcgacccguucccccaguccaacgcgcccaucaucgacgaggagcgggagauccccgagcgcagcugguccagcggccacgagugggugaccgacuucaaggggaagaccgucugguucgugccguccaucaaggccggcaacgacaucgccgccugccugcggaagaacggcaagaaggugauccagcucagccgcaagaccuucgacuccgaguacgucaagacgcggaccaacgacugggacuucguggugaccaccgacaucagcgagaugggggccaacuucaaggcggagcgcgucaucgacccccggcgcugcaugaagcccgugauccugacggacggcgaggagcgggugauccuggccgggcccaugccggucacccacuccagcgccgcccagcgccggggccgcaucgggcgcaaccccaagaacgagaacgaccaguacaucuacaugggcgagccccucgagaacgacgaggacugcgcccacuggaaggaggcgaagaugcugcuggacaacaucaacacccccgagggcaucaucccguccauguucgagcccgagcgggagaagguggacgccaucgacggggaguaccgccuccggggcgaggcccgcaagaccuucguggaccugaugcggcgcggggaccugcccgucuggcucgccuaccggguggccgcggagggcaucaacuacgccgaccgccgguggugcuucgacggggugaagaacaaccagauccuggaggagaacgucgagguggagaucuggacgaaggagggcgagcgcaagaagcugaagccgcgguggcucgacgcccgcaucuacagcgacccccuggcccugaaggaguucaaggaguucgcggccggccggaagucccucacccugaaccugaucaccgagauggggcgccuccccaccuucaugacgcagaaggcccgggacgcccuggacaaccuggccgugcuccacaccgcggaggccggcgggcgcgccuacaaccacgcccugagcgagcugcccgagacccucgagacccugcugcuccugacgcugcucgccaccgucaccggcggcaucuuccuguuccugauguccgggaagggcguggggaagaugacccucggcauguucugcaucaucaccgcgagcauccugcugugguacgcccagauccagccgcacuggaucgccgccagcaucauccucgaguucuuccugaucgugcugcucauccccgagcccgagaagcagcggacgccccaggacaaccagcugaccuacgucgugaucgccauccugaccgucguggcggccaccauggccaacgagaugggguuccucgagaagacgaagaaggaccugggccugggcuccaucgccacccaggagccggagagcaacauccucgacaucgaccugcgccccgccuccgcguggacccuguacgccguggccaccacguucgucacccccaugcuccggcacagcaucgagaacuccagcgugaacgugucccugaccgccaucgcgaaccaggccaccguccugauggggcucggcaagggguggccccugagcaagauggacaucggcgugccgcugcucgccaucgggugcuacucccaggugaaccccaucacgcugaccgccgcccugcuccugcugaucgcgcacuacgccaucaucggccccggccuccaggccaaggccacccgcgaggcccagaagcgggcggccgccgggaucaugaagaaccccaccgucgacggcaucacggugaucgaccuggacccgauccccuacgaccccaaguucgagaagcagcugggccaggugaugcuccugauccugugcgucacccaggugcucaugaugcgcaccaccugggcccugugcgaggcccugacgcucgcgaccggccccaucagcacccugugggaggggaacccgggccgcuucuggaacaccacgaucgccguguccauggccaacaucuuccggggcagcuaccuggccggggcgggccuccuguucuccaucaugaagaacaccaccaacacccgccgggggacgggcaacaucggcgagacccugggggagaaguggaagucccgccucaacgcccugggcaaguccgaguuccagaucuacaagaaguccgggauccaggaggucgaccggacccuggccaaggagggcaucaagcgcggggagaccgaccaccacgccgugucccggggcagcgccaagcuccgcugguucguggagcggaacauggucacgcccgagggcaaggugguggaccuggggugcggccgcgggggcugguccuacuacugcgggggccugaagaacguccgggaggugaagggccucaccaagggcggccccgggcacgaggagcccaucccgaugagcaccuacggcuggaaccuggugcgccugcagagcggggucgacguguucuucacgccgcccgagaagugcgacacgcuccugugcgacaucggcgaguccagccccaacccgaccaucgaggcgggccggacccugcgcgugcucucccuggucgagaacuggcugaacaacgacacccaguucugcaucaaggugcucaaccccuacaugcccagcgugaucgagaagauggagacccugcagcggaaguacgggggcgcccugguccgcaacccgcugucccggaacagcacgcacgagauguacuggguguccaacgccaccgggaacaucgugagcuccgucaacaugaucagccgcaugcucaucaaccgguucaccaugaagcacaagaaggccaccuacgagcccgacguggaccugggcuccgggacgcgcaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagaccaagcagacgggcuccgcgagcuccauggugaacggggucgugcggcuccugaccaagccgugggacgugguccccauggugacccagauggccaugaccgacacgacccccuucggccagcagcgcguguucaaggagaaggucgacacccggacccaggagcccaaggagggcacgaagaagcugaugaagaucaccgccgaguggcucuggaaggagcuggggaagaagaagaccccgcgcaugugcacccgggaggaguucacgcgcaaggugcggagcaacgccgcccugggcgcgaucuucaccgacgagaacaaguggaaguccgcccgcgaggccguggaggacagccgguucugggagcucgucgacaaggagcgcaaccugcaccuggaggggaagugcgagaccugcguguacaacaugaugggcaagcgggagaagaagcucggggaguucggcaaggccaagggcagccgcgcgaucugguacauguggcugggggcccgguuccuggaguucgaggcccucggcuuccugaacgaggaccacugguucucccgcgagaacagccuguccgggguggagggcgaggggcuccacaagcugggcuacauccugcgggacgucagcaagaaggagggcggggccauguacgccgacgacaccgcgggcugggacacgcgcaucacccucgaggaccugaagaacgaggagauggugaccaaccacauggagggggagcacaagcggcuggccgaggccaucuucaagcucaccuaccagaacaaggugguccgcgugcagcggcccacgccccgcggcaccgucauggacaucaucucccggcgcgaccagcgcgggagcggccaggugggcaccuacgggcugaacaccuucacgaacauggaggcccagcugauccggcagauggagggcgaggggaucuucaaguccauccagcaccucaccgugaccgaggagaucgccguccagaacuggcuggcgcgcgugggccgggagcgccugagccggauggccaucuccggcgacgacugcguggucaagccccucgacgaccgcuucgccagcgcccugaccgcccugaacgacauggggaaggugcggaaggacauccagcagugggagccguccaagggcuggaacgacuggacccaggugcccuucugcagccaccacuuccacgagcucaucaugaaggacgggcgcguccugguggugcccugccggaaccaggacgagcugaucggccgcgcgcggaucucccagggggccggcuggagccucaaggagaccgccugccugggcaaguccuacgcccagauguggagccugauguacuuccaccgccgggaccuccgccuggccgcgaacgccaucugcuccgccguccccagccacugggugccgaccagccggaccaccugguccauccacgccaagcacgaguggaugacgaccgaggacaugcugaccguguggaaccgcgucuggauccaggagaaccccuggauggaggacaagacccccguggagagcugggaggaggugcccuaccucgggaagcgggaggaccaguggugcggcucccugaucgggcugacgagccgcgcgaccugggccaagaacauccagaccgccaucaaccagguccggucccucaucggcaacgaggaguacaccgacuacaugccgagcaugaagcgcuuccgccgggaggaggaggaggccggggugcugugguga

SEQ ID NO: 9502 - RNA, 9876 nt, Artificial Sequence
  derived and/or modified CDS sequence (opt1) from DENV-2__EU482450__SS-prME
agcgcggggaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccguggucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgucaccgccggccacggccagguggacaacuucagccugggcgugcugggcauggcccucuuccuggaggagaugcugcggacccgcgucgggacgaagcacgcgauccuccugguggccguguccuucgucacccugaucaccggcaacaugagcuucaaggaccucgggcgggugguggucauggugggcgccaccaugacggacgacaucgggaugggcgugaccuaccuggcccugcucgccgcguucaagguccgccccaccuucgccgccggccugcugcuccggaagcugaccuccaaggagcugaugaugacgaccaucgggaucgugcuccugagccaguccgccauccccgagaccgugcuggagcucaccgacgcccuggcgcugggcaugaugguccucaagaucgugcgcaacauggagaaguaccagcuggccgucacgaucauggccauccugugcgugccgaacgccgugauccuccagaacgccuggaaggucagcugcaccauccuggcggugguguccgucagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcaugguguccauccuggccagcucccuccugaagaacgacauccccaugaccggcccccuggucgccgggggccuccugaccgugugcuacgugcugaccgggcgcagcgccgaccucgagcuggagcgggccacggacgucaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggugaagaagcagcgggccgggguccucugggacgugcccagcccgccgcccaugggcaaggcggagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcgcuggagcccggcaagaacccccgggccgugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucguccgggaggccaucaagcgcgggcugcggacccugauccucgcgccgacccgcgugguggccgccgagauggaggaggcccugcggggccugcccauccgcuaccagacccccgccauccgggcggagcacacggggcgcgagaucgucgaccucaugugccacgccaccuucaccaugcgccugcugagccccgugcgggugccgaacuacaaccucaucaucauggacgaggcccacuucaccgaccccgccuccaucgccgcgcgcggcuacaucagcacgcgggucgagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggugugguucgucccgagcaucaaggcggggaacgacaucgccgccugccugcggaagaacggcaagaaggugauccagcugucccgcaagaccuucgacagcgaguacgugaagacccggaccaacgacugggacuucgucgugacgaccgacaucuccgagaugggcgccaacuucaaggcggagcgcgugaucgacccccggcgcugcaugaagcccgucauccucaccgacggggaggagcgggugauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaaggucgacgccaucgacggcgaguaccggcugcgcggggaggcccgcaagaccuucguggaccucaugcggcgcggcgaccugcccguguggcuggccuacaaggucgccgcggaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccgugcugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucguccugcugauccccgagcccgagaagcagcggacgccccaggacaaccagcucacguacguggugaucgccauccugaccgucguggccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgucacgcccaugcugcggcacagcaucgagaacagcuccgugaacgugagccucaccgccaucgccaaccaggccaccguccugaugggccuggggaagggcuggccccucuccaagauggacaucggggugccgcugcuggcgaucggcugcuacagccaggugaaccccaucacccucacggccgcccugcugcuccuggucgcccacuacgcgaucaucgggcccggccugcaggccaaggccacccgcgaggcccagaagcgggccgcggccggcaucaugaagaaccccaccguggacgggaucaccgugaucgaccucgacccgauccccuacgaccccaaguucgagaagcagcugggccaggucaugcugcucauccugugcgugacccaggugcugaugaugcgcaccaccugggcccucugcgaggcccugacccuggccacggggcccaucuccacccucugggagggcaacccggggcgguucuggaacaccaccaucgcggucagcauggccaacaucuuccgcggcuccuaccuggccggcgccgggcuccucuucagcaucaugaagaacacgaccaacacccggcgcggcaccgggaacaugggcgagacgcugggcgagaaguggaagucccgccugaacgcccucgggaaguccgaguuccagaucuacaagaaguccggcauccaggagguggaccggacccuggcgaaggaggggaucaagcgcggcgagaccgaccaccacgccgugagccggggguccgccaagcugcgcugguucgucgagcggaacauggugacccccgagggcaagguggucgaccucggcugcgggcgcggcggguggagcuacuacugcggcgggcugaagaacgugcgggaggugaagggccugacgaagggcgggcccggccacgaggagcccaucccgauguccaccuacggguggaaccucguccgccugcagagcggcguggacguguucuucaucccgcccgagaagugcgacacccugcucugcgacaucggggaguccagccccaacccgaccgucgaggccggccggacgcugcgcgugcugaaccucguggagaacuggcugaacaacaacacccaguucugcaucaagguccugaaccccuacaugcccuccgugaucgagaagauggaggcgcugcagcggaaguacggcggggcccucgugcgcaacccgcugagccggaacagcacccacgagauguacugggucuccaacgccagcggcaacaucguguccagcgugaacaugaucucccgcaugcugaucaaccgguucaccaugcgccacaagaaggccaccuacgagcccgacgucgaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggugaacggcgugguccggcugcucaccaagccgugggacgugcugcccaccgugacccagauggccaugacggacaccacccccuucgggcagcagcgcgucuucaaggagaagguggacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggcgaucuucaccgacgagaacaaguggaaguccgcccgggaggccgucgaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgugagcaagaaggagggcggcgccauguacgccgacgacacggcggggugggacacccggaucacccucgaggaccugaagaacgaggagauggucaccaaccacauggagggcgagcacaagaagcuggccgaggccaucuucaagcucacguaccagaacaagguggugcgcguccagcggcccacgccccgggggaccgugauggacaucaucagccggcgcgaccagcggggcuccggccagguggggaccuacggccugaacacguucaccaacauggaggcccagcugauccgccagauggagggggagggcgucuucaagaacauccagcaccucaccgugaccgaggagguggccgucaagaacuggcuggcgcggguggggcgcgagcgccugagccggauggccaucuccggcgacgacugcguggucaagccccucgacgaccgcuucgccaacgcccugacggcccugaacgacaugggcaagauccggaaggacauccagcagugggagccgagcaagggguggaacgacuggacccaggugcccuucugcucccaccacuuccacgagcucaucaugaaggacggccgcgugcuggucgugcccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccgugcccucccacugggucccgaccagccgcacgaccugguccauccacgccaagcacgaguggaugaccaccgaggacaugcugaccguguggaaccggguguggauccgcgagaaccccuggauggaggacaagacgcccgucgagagcugggaggagauccccuaccucggcaagcgggaggaccaguggugcgggucccugaucggccugaccagccgcgccaccugggcgaagaacauccaggccgccaucaaccaggugcggucccucaucgggaacgaggaguacgccgacuacaugccgagcaugaagcgcuuccggcgcgaggaggaggaggcgggcgugcugugguga

SEQ ID NO: 9503 - RNA, 9876 nt, Artificial Sequence
  derived and/or modified CDS sequence (opt1) from DENV-2__EU569721__SS-prME
agcgcggggaugaucaucaugcugauccccaccgugauggccuuccaccucaccacccggaacggggagccccacaugaucgucgggauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcgcagcgucgcccuggugccccacguggggaugggccucgagacccggaccgagaccuggauguccagcgagggggccuggaagcacgcccagcgcaucgagaccuggauccugcggcaccccggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugcccgacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccccugccgaugggcaaggcggagcuggaggacggggccuaccgcaucaagcagaagggcauccucggguacagccagaucggcgccggcguguacaaggaggggaccuuccacaccauguggcacgugacccggggcgccguccugaugcacaaggggaagcgcaucgagcccuccugggccgacgugaagaaggaccugaucagcuacggcgggggcuggaagcucgagggcgaguggaaggagggggaggaggugcagguccuggcgcuggagcccggcaagaacccgcgggccgugcagacgaagcccggccucuucaagaccaacaccggcaccaucggggccgugucccuggacuucagccccggcacguccggcagccccaucaucgacaagaaggggaaggucgugggccuguacgggaacggcguggucacccgcuccggcgccuacgugagcgccaucgcgcagaccgagaaguccaucgaggacaacccggagaucgaggacgacaucuuccggaagaagcgccugaccaucauggaccuccaccccggggccggcaagacgaagcgguaccugcccgccaucgugcgcgaggccaucaagcgggggcugcgcacccucauccuggcgcccacccgggucguggccgccgagauggaggaggcccugcgcggccucccgauccgguaccagacccccgccauccgcgcggagcacacggggcgggagaucguggaccugaugugccacgccaccuucaccaugcgccugcucagccccguccgcgugcccaacuacaaccugaucaucauggacgaggcccacuucaccgacccggccuccaucgccgcgcggggcuacaucagcacgcgcguggagaugggcgaggccgccgggaucuucaugaccgccacgccgcccggcagccgggaccccuucccgcaguccaacgcccccaucaucgacgaggagcgcgagauccccgagcggagcuggaacuccgggcacgagugggucaccgacuucaagggcaagacggugugguucgugcccagcaucaaggcggggaacgacaucgccgccugccugcgcaagaacggcaagaaggucauccagcucucccggaagaccuucgacagcgaguacgugaagacccgcaccaacgacugggacuucguggucacgaccgacaucuccgagaugggcgccaacuucaaggcggagcgggugaucgacccgcgccggugcaugaagcccgugauccugaccgacggggaggagcgcgucauccuggccggccccaugcccgugacccacagcuccgccgcccagcggcgcgggcggaucggccgcaacccgaagaacgagaacgaccaguacaucuacaugggggagccccucgagaacgacgaggacugcgcccacuggaaggaggcgaagaugcugcuggacaacaucaacacgcccgagggcaucauccccagcauguucgagccggagcgggagaagguggacgccaucgacggcgaguaccgccuccgcggggaggcccgcaagaccuucgucgaccugaugcgccggggcgaccugcccguguggcucgccuacaagguggccgcggaggggaucaacuacgccgaccgccgguggugcuucgacggcaucaagaacaaccagauccuggaggagaacgucgagguggagaucuggaccaaggagggggagcgcaagaagcugaagccccgguggcucgacgcccgcaucuacuccgacccgcuggcccugaaggaguucaaggaguucgccgcgggccggaagucccucacccugaaccugaucacggagaugggccgccuccccaccuucaugacccagaagacccgggacgcccuggacaaccuggccguccuccacacggccgaggccggcgggcgcgccuacaaccacgcccuguccgagcugcccgagacccucgagacccugcugcuccugacccugcucgccacggugaccgggggcaucuuccuguuccugaugagcggccgggggaucggcaagaugacccucgggaugugcugcaucaucaccgccuccauccugcugugguacgcgcagauccagccccacuggaucgccgccagcaucauccucgaguucuuccugaucgugcugcucaucccggagcccgagaagcagcgcacgccccaggacaaccagcugacguacgucgugaucgccauccugaccguggucgccgcgaccauggccaacgagaugggcuuccucgagaagaccaagaaggaccuggggcugggcuccaucgccacgcagcagcccgagagcaacauccucgacaucgaccugcggccggccuccgccuggacccuguacgcgguggccaccaccuucgugacgcccaugcuccgccacagcaucgagaacagcuccgucaacgugagccugaccgccaucgccaaccaggccaccgugcugaugggccucgggaagggcuggccccuguccaagauggacaucggggucccccugcucgcgaucggcugcuacagccaggugaacccgaucacccugacggccgcccugcuccugcugguggcccacuacgcgaucaucgggcccggccuccaggccaaggccacccgggaggcccagaagcgcgccgcggccggcaucaugaagaaccccaccgucgacgggaucaccgugaucgaccuggaccccaucccguacgaccccaaguucgagaagcagcugggccaggugaugcuccugauccugugcgucacccaggugcucaugaugcggaccaccugggcccugugcgaggcccugacccucgccacggggcccaucuccacccugugggagggcaaccccgggcgcuucuggaacaccaccaucgcggugagcauggccaacaucuuccggggcuccuaccuggccggcgccgggcuccuguucagcaucaugaagaacacgaccaacacccgccggggcaccgggaacaugggcgagacgcugggcgagaaguggaagucccgccucaacgcccugggcaagagcgaguuccagaucuacaagaaguccggcauccaggaggucgaccgcacccuggcgaaggaggggaucaagcggggcgagaccgaccaccacgccgugagccgcggguccgccaagcuccggugguucguggagcgcaacauggucaccccggagggcaaggugguggaccugggcugcgggcggggcggguggagcuacuacugcggcgggcugaagaacguccgcgaggugaagggccucacgaagggcgggcccggccacgaggagcccauccccauguccaccuacggguggaaccuggugcggcugcagagcggcgucgacguguucuucaucccgcccgagaagugcgacacccuccugugcgacaucggggaguccagccccaaccccaccguggaggccggccgcacgcugcggguccucaaccugguggagaacuggcugaacaacaacacccaguucugcaucaaggugcugaacccguacaugcccuccgucaucgagaagauggaggcgcuccagcgcaaguacggcggggcccuggugcggaacccccugagccgcaacagcacccacgagauguacuggguguccaacgccagcggcaacaucgucuccagcgugaacaugaucucccggaugcucaucaaccgcuucaccaugcggcacaagaaggccaccuacgagccggacguggaccuggggagcggcacgcgcaacaucgggaucgaguccgagacccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgcguccagcauggucaacggcguggugcgccuccugaccaagcccugggacguccugccgaccgugacgcagauggccaugaccgacaccacccccuucgggcagcagcggguguucaaggagaaggucgacacgcgcacccaggagcccaaggagggcaccaagaagcucaugaagaucaccgccgaguggcuguggaaggagcugggcaagaagaagacgccccgcaugugcacccgggaggaguucacccgcaaggugcgguccaacgccgcccucggggcgaucuucaccgacgagaacaaguggaaguccgcccgcgaggccguggaggacucccgguucugggagcuggucgacaaggagcgcaaccugcaccucgagggcaagugcgagacgugcguguacaacaugauggggaagcgggagaagaagcugggcgaguucgggaaggccaagggcagccgcgccaucugguacauguggcugggcgcgcgguuccucgaguucgaggcccugggguuccugaacgaggaccacugguucucccgcgagaacagccucuccggcgucgagggggagggccugcacaagcugggguacauccuccgggacgugagcaagaaggagggcggcgccauguacgccgacgacaccgcggggugggacacccgcaucacccuggaggaccugaagaacgaggagauggugacgaaccacauggagggcgagcacaagaagcucgccgaggccaucuucaagcugaccuaccagaacaaggucgugcgggugcagcgcccgacgccccgggggaccgucauggacaucaucagccgccgggaccagcgcggcuccggccagguggggacguacggccugaacaccuucaccaacauggaggcccagcucauccggcagauggagggggagggcguguucaagaacauccagcaccugaccgucacggaggagguggccgugcagaacuggcuggcgcgcgucgggcgggagcgccucagccgcauggccaucuccggcgacgacugcguggugaagccccuggacgaccgguucgccaacgcccugaccgcccucaacgacaugggcaagauccgcaaggacauccagcagugggagcccagcaagggguggaacgacuggacccaggucccguucugcucccaccacuuccacgagcugaucaugaaggacggccgggugcuggugguccccugccgcaaccaggacgagcucaucgggcgggcgcgcaucagccagggcgccggguggucccugcgggagaccgccugccugggcaagagcuacgcccagauguggucccucauguacuuccaccgccgggaccugcgccuggccgcgaacgccaucugcagcgccgugcccucccacugggugcccacgagccggaccaccugguccauccacgccaagcacgaguggaugaccaccgaggacaugcucacggucuggaaccgcguguggauccgggagaacccguggauggaggacaagacccccguggagagcugggaggagauccccuaccugggcaagcgcgaggaccaguggugcgggucccugaucggccucaccagccgggccaccugggcgaagaacauccaggccgccaucaaccagguccgcucccugaucgggaacgaggaguacacggacuacaugcccagcaugaagcgguuccgccgggaggaggaggaggccggcgugcugugguga

SEQ ID NO: 9504 - RNA, 9876 nt, Artificial Sequence
  derived and/or modified CDS sequence (opt1) from DENV-2__EU482451__SS-prME
agcgccggcaugaucaucaugcugauccccaccgugauggccuuccaccucaccacccggaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcggagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcggguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcgggcuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccggggccgagcugaccggcuacggcaccgucacgauggagugcagcccccggaccgggcucgacuucaacgagauggugcugcugcagauggagaacaaggccuggcucgugcaccgccagugguuccuggaccugccccuccccuggcugccgggcgccgacaagcaggaguccaacuggauccagaaggagacccuggucaccuucaagaacccccacgccaagaagcaggacguggucgugcucgggagccaggagggcgcgaugcacacggcccugaccggggccaccgagauccagaugagcuccggcaaccuccuguucaccggccaccugaagugccggcugcgcauggacaagcuccagcugaaggggaugagcuacuccaugugcacgggcaaguucaagguggucaaggagaucgccgagacccagcacgggaccaucgugauccgggugcaguacgagggcgacggcagccccugcaagauccccuucgagaucauggaccuggagaagcgcuacguccucgggcggcugaucaccgugaacccgaucgugacggagaaggacucccccgucaacaucgaggccgagccgcccuucggcgacagcuacaucaucaucgggguggagccgggccagcugaagcucaacugguucaagaagggguccagcaucggccagauguucgagaccaccaugcgcggcgcgaagcgcauggccauccugggggacaccgccugggacuucggcucccucggcgggguguucacgagcaucgggaaggcccuccaccaggucuucggggccaucuacggcgcggccuucuccggggugagcuggaccaugaagauccugaucggcgugaucaucaccuggaucgggaugaacucccggagcaccucccugagcgucucccuggugcucgugggcaucgucacgcuguaccugggggugauggugcaggccgacagcggcugcgucguguccuggaagaacaaggagcucaagugcggcagcgggaucuucgugaccgacaacguccacaccuggaccgagcaguacaaguuccagcccgagagccccuccaagcuggccagcgcgauccagaaggcccaggaggagggcaucugcgggauccgcuccgugacgcggcuggagaaccucauguggaagcagaucacccccgagcugaaccacauccuggccgagaacgaggugaagcucaccaucaugaccggcgacaucaaggggaucaugcaggccggcaagcgcagccugcggccgcagcccacggagcugaaguacuccuggaagaccuggggcaaggccaagaugcucagcaccgaguccuacaaccagaccuuccugaucgacgggcccgagacggcggagugcccgaacaccaaccgcgccuggaacagccuggaggucgaggacuacggcuucgggguguucaccaccaacaucuggcucaagcugaaggagaagcaggacgccuucugcgacuccaagcugaugagcgccgccaucaaggacaaccgggcggugcacgccgacaugggcuacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgccgggcccgugagccagcacaacuaccgcccgggcuaccacacccagaucgcggggcccuggcaccugggcaagcuggagauggacuucgacuucugcgacgggaccaccgucaucgugacggaggacugcggcaaccggggccccucccuccgcaccaccaccgccagcgggaagcugaucacggaguggugcugccggagcugcacccugcccccgcuccgcuaccggggcgaggacgggugcugguacggcauggagauccgcccccugaaggagaaggaggagaaccuggugaacucccucgucaccgccgggcacggccagguggacaacuucagccugggcgugcuggggauggcccucuuccuggaggagaugcugcggacccgcgucggcacgaagcacgcgauccuccugguggccguguccuucgucacccugaucaccgggaacaugagcuucaaggaccucggccgggugguggucauggugggggccaccauggccgacgacaucggcaugggcgugacguaccuggcccugcucgcggccuucaagguccgccccaccuucgccgccgggcugcugcuccggaagcugaccuccaaggagcugaugaugaccacgaucggcaucgugcuccugagccaguccaccauccccgagaccgugcuggagcucaccgacgcccuggcgcuggggaugaugguccucaagaucgugcgcaacauggagaaguaccagcuggccgucacgaucauggccauccugugcgugccgaacgccgugauccuccagaacgccuggaaggucagcugcaccauccuggcggugguguccgucagcccccugcuccugaccuccagccagcagaagaccgacuggaucccccuggcccucacgaucaagggccugaaccccaccgccaucuuccugaccacccucucccgcacgaacaagaagcggagcuggccgcugaacgaggccaucauggcggugggcaugguguccauccuggccagcucccuccugaagaacgacauccccaugaccgggccccuggucgccggcgggcuccugaccgugugcuacgugcugaccggccgcagcgccgaccucgagcuggagcgggccacggacgucaagugggaggaccaggcggagaucuccgggagcagccccauccuguccaucaccaucagcgaggacggcuccaugagcaucaagaacgaggaggaggagcagacccucaccauccugauccgcacgggccugcucgugaucuccgggcuguucccgaucagcauccccaucaccgccgccgccugguaccugugggaggugaagaagcagcgggccggcguccucugggacgugcccagcccgccgcccauggggaaggcggagcuggaggacggcgccuaccgcaucaagcagaaggggauccugggcuacagccagaucggcgccgggguguacaaggagggcaccuuccacaccauguggcacgucacccgcggggccgugcucaugcacaagggcaagcgcaucgagcccuccugggccgacgugaagaaggaccugaucagcuacgggggcggcuggaagcuggagggggaguggaaggagggcgaggagguccaggugcucgcgcuggagcccgggaagaacccccgggccgugcagacgaagcccggccuguucaagaccuccaccgggaccaucggcgccgucagccucgacuucucccccggcacgagcgggucccccaucaucgacaagaagggcaaggugguggggcuguacggcaacggcgucgugacccgcagcggggccuacguguccgccaucgcgcagaccgagaaguccaucgaggacaaccccgagaucgaggacgacaucuuccggaagcgccggcugaccaucauggaccugcaccccggcgccgggaagacgaagcgcuaccuccccgccaucguccgggaggccaucaagcgcggccugcggacccugauccucgcgccgacccgcgugguggccgccgagauggaggaggcccugcgggggcugcccauccgcuaccagacccccgccauccgggcggagcacacgggccgcgagaucgucgaccucaugugccacgccaccuucaccaugcgccugcugucccccgugcgggugccgaacuacaaccucaucaucauggacgaggcccacuucaccgaccccgccagcaucgccgcgcgcggcuacaucagcacgcgggucgagaugggggaggccgccggcaucuucaugaccgccacgccgcccgggucccgcgacccguucccccagagcaacgcccccaucaucgacgaggagcgggagauccccgagcgcuccuggaacagcggccacgagugggugaccgacuucaaggggaagacggugugguucgucccguccaucaaggcgggcaacgacaucgccgccugccugcggaagaacggcaagaaggugauccagcugagccgcaagaccuucgacuccgaguacgugaagaccaagaccaacgacugggacuucgucgugacgaccgacaucagcgagaugggggccaacuucaaggcggagcgggugaucgacccccgccggugcaugaagcccgucauccucaccgacggcgaggagcgcgugauccuggccgggcccaugccggugacccacuccagcgccgcccagcggcgcggccggaucgggcgcaaccccaagaacgagaacgaccaguacaucuacaugggcgagccccuggagaacgacgaggacugcgcccacuggaaggaggcgaagaugcuccuggacaacaucaacacgcccgagggcaucaucccguccauguucgagcccgagcgggagaaggucgacgccaucgacggggaguaccgccugcggggcgaggcccgcaagaccuucguggaccucaugcgccgcggggaccugcccguguggcuggccuacaaggucgccgcggagggcaucaacuacgccgaccgccgguggugcuucgacgggaucaagaacaaccagauccucgaggagaacguggaggucgagaucuggaccaaggagggcgagcgcaagaagcugaagccgcgguggcuggacgcccgcaucuacagcgacccccucgcccugaaggaguucaaggaguucgccgcgggccggaagucccugacccucaaccugaucacggagauggggcgccugcccaccuucaugacccagaagacccgggacgcccucgacaaccuggccgugcugcacacggccgaggcgggcgggcgcgccuacaaccacgcccucagcgagcugcccgagacccuggagacccuccugcugcucacccugcuggccacggugaccggcggcaucuuccucuuccugauguccgggcggggcaucgggaagaugacccugggcaugugcugcaucaucaccgccagcauccuccugugguacgcgcagauccagccgcacuggaucgccgccuccaucauccuggaguucuuccucaucguccugcugauccccgagcccgagaagcagcgcacgccccaggacaaccagcucacguacguggugaucgccauccugaccgucguggccgcgaccauggccaacgagaugggguuccuggagaagaccaagaaggaccucggccugggcagcaucgccacgcagcagccggaguccaacauccuggacaucgaccuccggcccgccagcgccuggacccuguacgcgguggccaccaccuucgucacgcccaugcugcgccacagcaucgagaacuccagcgugaacgugucccucaccgccaucgccaaccaggccaccguccugauggggcugggcaagggguggccccucagcaagauggacaucggcgugccgcugcuggcgaucgggugcuacucccaggugaaccccaucacccucacggccgcccugcugcuccuggucgcccacuacgcgaucaucggccccggccugcaggccaaggccacccgggaggcccagaagcgcgccgcggccgggaucaugaagaaccccaccguggacggcaucaccgugaucgaccucgacccgauccccuacgaccccaaguucgagaagcagcuggggcaggucaugcugcucauccugugcgugacccaggugcugaugaugcggaccaccugggcccucugcgaggcccugacccuggccacgggccccaucagcacccucugggaggggaacccgggccgcuucuggaacaccaccaucgcggucuccauggccaacaucuuccggggcagcuaccuggccggggccggccuccuguucuccaucaugaagaacacgaccaacacccgccgggggaccggcaacaucggcgagacgcugggggagaaguggaagucccgccugaacgcccucggcaaguccgaguuccagaccuacaagaaguccgggauccaggagguggaccgcacccuggcgaaggagggcaucaagcgcggggagaccgaccaccacgccgugucccgcggcagcgccaagcugcggugguucgucgagcgcaacauggugacgcccgagggcaagguggucgaccucgggugcggccgcgggggcugguccuacuacugcgggggccugaagaacgugcgcgaggugaagggccugaccaagggcggccccgggcacgaggagcccaucccgaugagcaccuacggcuggaaccucguccggcugcaguccgggguggacguguucuucaucccgcccgagaagugcgacacccugcucugcgacaucggcgagagcucccccaacccgacggucgaggccggccgcacccugcgggugcugaaccucguggagaacuggcugaacaacaacacccaguucugcaucaagguccugaaccccuacaugcccagcgugaucgagaagauggaggcgcugcagcgcaaguacgggggcgcccucgugcggaacccgcugagccgcaacuccacccacgagauguacugggucagcaacgccuccgggaacaucgugagcuccgugaacaugaucagccggaugcugaucaaccgcuucaccaugcggcacaagaaggccacguacgagcccgacgucgaccucggcuccgggacccgcaacaucggcaacgagagcgagauccccaaccuggacaucaucggcaagcggaucgagaagaucaagcaggagcacgagaccuccuggcacuacgaccaggaccaccccuacaagaccugggccuaccacgggagcuacgagacgaagcagaccggcuccgcgagcuccauggugaacggggugguccgccugcucaccaagccgugggacgugcugcccaccgugacgcagauggccaugaccgacaccacccccuucggccagcagcgggucuucaaggagaagguggacacgcgcacccaggagcccaaggagggcaccaagaagcugaugaagaucaccgccgaguggcucuggaaggagcuggggaagaagaagacgccgcgcaugugcacccgggaggaguucacccgcaaggugcggagcaacgccgcccugggcgcgaucuucaccgacgagaacaaguggaaguccgcccgcgaggccgucgaggacagccgguucugggagcucguggacaaggagcgcaaccugcaccuggaggggaagugcgagacgugcgucuacaacaugaugggcaagcgggagaagaagcucggggaguucggcaaggccaagggcucccgcgccaucugguacauguggcugggggcgcgguuccuggaguucgaggcccucggcuuccugaacgaggaccacugguucagccgcgagaacucccugagcgggguggagggcgaggggcuccacaagcugggcuacauccugcgggacgugagcaagaaggagggcggggccauguacgccgacgacaccgcgggcugggacacccgcaucacccucgaggaccugaagaacgaggagauggucacgaaccacauggagggggagcacaagaagcuggccgaggccaucuucaagcucaccuaccagaacaagguggugcggguccagcgccccacgccccggggcaccgugauggacaucaucucccgccgggaccagcgcgggagcggccaggugggcacguacgggcugaacaccuucaccaacauggaggcccagcugauccggcagauggagggcgagggggucuucaagaacauccagcaccucaccgugacggaggagguggccguccagaacuggcuggcgcgcgugggccgggagcgccugucccgcauggccaucagcggcgacgacugcguggucaagccccucgacgaccgguucgccaacgcccugaccgcccugaacgacauggggaagauccgcaaggacauccagcagugggagccguccaagggcuggaacgacuggacccaggugcccuucugcagccaccacuuccacgagcucaucaugaaggacgggcgggugcuggucgugcccugccgcaaccaggacgagcugaucggccgggcgcgcaucucccagggggccggcuggagccuccgggagaccgccugccugggcaaguccuacgcccagauguggagccugauguacuuccaccgccgggaccuccgccuggccgcgaacgccaucugcuccgccgugcccagccacugggucccgacgucccggaccaccuggagcauccacgccaagcacgaguggaugaccaccgaggacaugcugacgguguggaaccgcguguggauccgggagaaccccuggauggaggacaagacccccgucgaguccugggaggagauccccuaccucgggaagcgcgaggaccaguggugcggcagccugaucgggcugaccucccgggccaccugggcgaagaacauccagguggccaucaaccaggugcgcagccucaucggcaacgaggaguacacggacuacaugccgagcaugaagcgguuccgccgggaggaggaggaggccgggguccugugguga

SEQ ID NO: 9505 - RNA, 9876 nt, Artificial Sequence
  derived and/or modified CDS sequence (opt1) from DENV-2__EU660413__SS-prME
agcgcgggcaugaucaucaugcugauccccaccgugauggccuuccaccucaccacccggaacggggagccccacaugaucgugggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcggagcguggcccuggugccccacguggggaugggccucgagacgcggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccucuucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggcuucgacuucaacgagauggugcuccugcagauggagaacaaggccuggcuggugcaccgccagugguuccucgaccugccccugcccuggcucccgggggccgacaagcaggaguccaacuggauccagaaggagacccuggucaccuucaagaacccccacgccaagaagcaggacguggucauccugggcagccaggagggggcgaugcacacggcccucaccggcgccaccgagauccagaugagcuccgggaaccugcuguucaccggccaccucaagugccggcugcgcauggacaagcugcagcucaagggcaugagcuacuccaugugcacggggaaguucaagguggugaaggagaucgccgagacccagcacggcaccaucgucauccgggugcaguacgagggggacggcagccccugcaagauccccuucgagaucauggaccuggagaagcgcuacgugcugggccggcucaucaccgucaacccgaucgugacggagaaggacucccccgugaacaucgaggccgagccgcccuucggggacagcuacaucaucaucggcgucgagccggggcagcugaagcugaacugguucaagaagggcuccagcaucgggcagauguucgagaccaccaugcgcggcgcgaagcgcauggccauccucggcgacaccgccugggacuucgggucccugggcgggguguucacgagcaucggcaaggcccugcaccagguguucggggccaucuacggcgcggccuucuccggcgucagcuggaccaugaagauccucaucggggugaucaucaccuggaucggcaugaacucccggagcaccucccugagcgugucccugguccugguggggaucgugacgcucuaccugggcgucauggugcaggccgacagcgggugcguggucuccuggaagaacaaggagcugaagugcggcagcggcaucuucaucaccgacaacgugcacaccuggaccgagcaguacaaguuccagcccgagagccccuccaagcucgccagcgcgauccagaaggcccaggaggaggggaucugcggcauccgcuccgugacgcggcuggagaaccugauguggaagcagaucacccccgagcucaaccacauccuggccgagaacgaggucaagcugaccaucaugaccggggacauccgcggcaucaugcaggccgggaagcggagccuccgcccgcagcccacggagcugaaguacuccuggaagaccuggggcaaggccaagaugcugagcaccgaguccuacaaccagaccuuccucaucgacggccccgagacggcggagugcccgaacaccaaccgggccuggaacagccuggagguggaggacuacggguucggcguguucaccaccaacaucuggcugaagcucaaggagaagcaggacgccuucugcgacuccaagcugaugagcgccgccaucaaggacaaccgcgcgguccacgccgacaugggguacuggaucgaguccgcccugaacgacacguggaagaucgagaaggccagcuucaucgaggugaagaacugccacuggcccaagucccacacccucuggagcaacggcgugcuggaguccgagaugaucauccccaagaaccuggccggccccgucagccagcacaacuaccggccgggguaccacacccagaucgcgggccccuggcaccucgggaagcuggagauggacuucgacuucugcgacggcaccaccgugaucgugacggaggacugcgggaaccgcggccccucccugcggaccaccaccgccagcggcaagcucaucacggaguggugcugccgcagcugcacccugcccccgcugcgguaccgcggggaggacggcugcugguacgggauggagauccggccccucaaggagaaggaggagaaccuggucaacucccuggugaccgccggccacggccagguggacaacuucagccucggcguccugggcauggcccuguuccucgaggagaugcugcgcacccggguggggacgaagcacgcgauccugcucguggccgucuccuucgugacccugaucaccggcaacaugagcuucaaggaccuggggcgcguggucgugauggugggcgccaccauggccgacgacaucgggaugggcgucacguaccucgcccugcuggcggccuucaaggugcggcccaccuucgccgccggccuccugcugcgcaagcucaccuccaaggagcugaugaugaccacgaucgggaucgugcugcucagccaguccaccauccccgagaccguccuggagcugaccgacgcccucgcgcugggcaugauggugcugaagaucgugcgcaacauggagaaguaccagcucgccgucacgaucauggccauccugugcgugccgaacgccgucauccugcagaacgccuggaaggugagcugcaccauccucgcgguggucuccgugagcccccugcugcucaccuccagccagcagaagaccgacuggaucccccuggcccugacgaucaaggggcucucccccaccgccaucuuccugaccacccugagccgguccaacaagaagcgcagcuggccgcucaacgaggccaucauggcggugggcauggucuccauccuggccagcucccugcucaagaacgacauccccaugacgggcccccugguggccgggggccugcucaccgugugcuacguccugaccgggcggagcgccgaccuggagcucgagcgcgccaccgacgugaagugggaggaccaggcggagaucagcggcuccagccccauccuguccaucacgaucagcgaggacggguccaugagcaucaagaacgaggaggaggagcagacccugaccauccucauccggaccggccugcuggugaucuccggccucuucccgaucagcauccccaucacggccgccgccugguaccugugggaggucaagaagcagcgcgccggggugcugugggacgugcccagcccgccgcccaugggcaaggcggagcucgaggacggggccuaccggaucaagcagaagggcauccugggguacagccagaucggcgccggcgucuacaaggaggggaccuuccacaccauguggcacgugacccgcggcgccgugcugaugcacaaggggaagcggaucgagcccuccugggccgacgucaagaaggaccucaucagcuacggcgggggcuggaagcuggagggcgaguggaaggagggggaggagguccaggugcuggcgcucgagcccggcaagaacccccgcgccguccagaccaagcccgggcuguucaagacgaacaccggcaccaucggggccgugucccuggacuucagccccggcaccuccggcagccccaucaucgacaagaaggggaagguggucggccucuacgggaacggcguggugacgcgguccggcgccuacgucagcgccaucgcgcagaccgagaaguccaucgaggacaaccccgagaucgaggacgacaucuuccgcaagcggcgccugaccaucauggaccugcaccccggggccggcaagaccaagcgguaccugcccgccaucgugcgcgaggccaucaagcgggggcuccgcacgcugauccuggcgccgacccggguggucgccgccgagauggaggaggcccuccgcggccugcccauccgguaccagacccccgccauccgcgcggagcacaccgggcgcgagaucguggaccugaugugccacgccacguucaccaugcggcuccugagccccgugcgcgucccgaacuacaaccugaucaucauggacgaggcccacuucaccgaccccgccagcaucgccgcgcggggcuacaucuccacccgcguggagaugggcgaggccgccgggaucuucaugacggccacgccgcccggcagccgggacccguucccccaguccaacgcccccaucaucgacgaggagcgcgagauccccgagcggagcuggaacuccgggcacgagugggugaccgacuucaagggcaagaccgucugguucgugccgagcaucaaggcggggaacgacaucgccgccugccuccgcaagaacggcaagaaggugauccagcugucccggaagacguucgacagcgaguacgucaagacccgcaccaacgacugggacuucguggugaccacggacaucuccgagaugggcgccaacuucaaggcggagcgggucaucgacccccgccggugcaugaagcccgugauccugaccgacggggaggagcgcgugauccucgccggccccaugccggucacccacagcuccgccgcccagcggcgcgggcggaucggccgcaaccccaagaacgagaacgaccaguacaucuacaugggggagccccuggagaacgacgaggacugcgcccacuggaaggaggcgaagaugcugcucgacaacaucaacacccccgagggcaucaucccgagcauguucgagcccgagcgggagaagguggacgccaucgacggcgaguaccgccugcgcggggaggcccggaagacguucguggaccugaugcgccggggcgaccuccccgucuggcuggccuacaagguggccgcggaggggaucaacuacgccgaccgccgguggugcuucgacggcaucaagaacaaccagauccuggaggagaacguggaggucgagaucuggaccaaggagggggagcgcaagaagcucaagccgcgguggcuggacgcccgcaucuacuccgacccccuggcccucaaggaguucaaggaguucgccgcgggccggaagucccugacccugaaccucaucaccgagaugggccgccugcccacguucaugacccagaagacccgggacgcccuggacaaccucgccgugcugcacaccgccgaggccggcgggcgcgccuacaaccacgcccuguccgagcuccccgagacgcuggagacccugcuccugcugacccuccuggccaccgucaccggcgggaucuuccuguuccucaugagcgggcgggggaucgggaagaugacccuggggaugugcugcaucaucaccgccuccauccugcucugguacgcgcagauccagccgcacuggaucgccgccagcaucauccuggaguucuuccugaucgugcuccugauccccgagcccgagaagcagcgcacgccccaggacaaccagcugaccuacguggucaucgccauccucacggugguggccgcgaccauggccaacgagaugggcuuccuggagaagaccaagaaggaccuggggcucggcggcaucgccacccagcagccggaguccaacauccuggacaucgaccugcggcccgccagcgccuggacgcucuacgcggucgccaccaccuucgugacccccaugcugcgccacagcaucgagaacuccagcgugaacgucucccugacggccaucgccaaccaggccaccgugcucauggggcugggcaagggguggccccugagcaagauggacaucggcgugccgcuccuggcgaucgggugcuacucccaggucaaccccaucacccugaccgccgcccuccugcugcucguggcccacuacgcgaucaucggccccggccugcaggccaaggccacgcgggaggcccagaagcgcgccgcggccgggaucaugaagaaccccaccguggacggcaucaccgucaucgaccuggacccgauccccuacgaccccaaguucgagaagcagcucggccaggugaugcugcugauccucugcgugacccagguccugaugaugcggacgaccugggcccugugcgaggcccucacccuggccaccggccccaucagcacgcugugggaggggaacccgggccgcuucuggaacaccaccaucgcgguguccauggccaacaucuuccggggcagcuaccucgccggggccggccugcuguucuccaucaugaagaacaccacgaacacccgccgcgggaccggcaacaucggcgagacccucggggagaaguggaagucccggcugaacgcccugggcaaguccgaguuccagaucuacaagaaguccgggauccaggagguggaccgcacgcucgcgaaggagggcaucaagcgcggggagaccgaccaccacgccgucucccgcggcagcgccaagcugcggugguucguggagcgcaacauggugacccccgagggcaaggucguggaccuggggugcggccgcggcgggugguccuacuacugcggcgggcucaagaacgugcgcgaggucaaggggcugaccaagggcgggcccgggcacgaggagcccaucccgaugagcacguacggcuggaaccuggugcggcuccaguccgggguggacgucuucuucaucccgcccgagaagugcgacacccugcugugcgacaucggcgagagcucccccaacccgaccguggaggccggccgcacccuccgggugcugaaccuggucgagaacuggcucaacaacaacacgcaguucugcaucaaggugcugaaccccuacaugcccagcgugaucgagaagauggaggcgcugcagcgcaaguacgggggcgcccugguccggaacccgcucagccgcaacuccacccacgagauguacugggugagcaacgccuccgggaacaucgugagcuccgucaacaugaucagccggaugcugaucaaccgcuucaccaugcggcacaagaaggccaccuacgagcccgacguggaccugggcuccgggacccgcaacaucggcaucgagagcgagaagcccaaccucgacaucaucggcaagcggaucgagaagaucaagcaggagcacgagacguccuggcacuacgaccaggaccaccccuacaagaccugggccuaccacgggagcuacgagaccaagcagaccggcuccgcgagcuccauggugaacggggucgugcgccugcugacgaagccgugggacgugcuccccaccgucacccagauggccaugaccgacacgacccccuucggccagcagcgcguguucaaggagaagguggacacccggacccaggagcccaaggagggcacgaagaagcugaugaagaucaccgccgaguggcuguggaaggagcucgggaagaagaagaccccgcgcaugugcacccgggaggaguucacgcgcaagguccggagcaacgccgcccugggcgcgaucuucaccgacgagaacaaguggaaguccgcccgcgaggccguggaggacagccgguucugggagcugguggacaaggagcgcaaccuccaccuggaggggaagugcgagaccugcgucuacaacaugaugggcaagcgggagaagaagcugggggaguucggcaaggccaagggcucccgcgccaucugguacauguggcucggggcgcgguuccuggaguucgaggcccugggcuuccucaacgaggaccacugguucagccgcgagaacucccugagcgggguggagggcgaggggcugcacaagcucggcuacauccugcgggacgucagcaagaaggagggcggggccauguacgccgacgacaccgcgggcugggacacgcgcaucacccuggaggaccucaagaacgaggagauggugaccaaccacauggagggggagcacaagaagcuggccgaggccaucuucaagcugaccuaccagaacaaggugguccgggugcagcgccccacgccccggggcaccgugauggacaucaucucccgccgggaccagcgcgggagcggccaggucggcaccuacgggcucaacaccuucacgaacauggaggcccagcugauccggcagauggagggcgaggggguguucaagaacauccagcaccugaccgugaccgaggaggucgccgugcacaacuggcucgcgcgcgugggccgcgagcggcugucccgcauggccaucagcggcgacgacugcgucgugaagccccuggacgaccgguucgccaacgcccucaccgcccugaacgacauggggaagauccgcaaggacauccagcagugggagccguccaagggcuggaacgacuggacgcagguccccuucugcagccaccacuuccacgagcugaucaugaaggacgggcggguccucguggugcccugccgcaaccaggacgagcugaucggccgggcgcgcaucucccagggggccggcuggagccugcgggagaccgccugccucggcaaguccuacgcccagauguggagccugauguacuuccaccgccgggaccugcgccucgccgcgaacgccaucugcuccgccguccccagccacugggugccgaccucccggaccacguggagcauccacgccaagcacgaguggaugaccaccgaggacaugcugaccguguggaaccgcgucuggauccgggagaaccccuggauggaggacaagacccccguggaguccugggaggagauccccuaccuggggaagcgcgaggaccaguggugcggcagccucaucgggcugacgucccgggccaccugggcgaagaacauccaggccgccaucaaccaggugcgcagccugaucggcaacgaggaguacaccgacuacaugccgagcaugaagcgguuccgccgcgaggaggaggaggccgggguccucugguga

SEQ ID NO: 9506 - RNA, 9876 nt, Artificial Sequence
  derived and/or modified CDS sequence (opt1) from DENV-2__EU660414__SS-prME
agcgcgggcaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggguccugcggcacccgggcuucacgaucauggccgcgauccuggccuacaccaucgggaccacccacuuccagcgcgugcucaucuucauccugcugacggccguggcccccuccaugaccaugcggugcaucggcaucagcaaccgcgacuucgucgagggcguguccgggggcagcuggguggacaucguccucgagcacggguccugcgugaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcauggucgaccgcggcugggggaacggcugcggccuguucggcaagggcgggaucgugacgugcgccauguucacgugcaagaagaacauggagggcaagaucgugcagcccgagaaccuggaguacaccaucgucgugacgccccacuccggggaggagcacgcggugggcaacgacacggggaagcacggccaggagaucaaggucaccccgcagagcuccaucaccgaggccgagcugaccggguacggcaccgugacgauggagugcagcccccggaccggccucgacuucaacgagauggugcugcugcagauggagaacaaggccuggcucguccaccgccagugguuccuggaccugccccuccccuggcugccgggggccgacaagcaggaguccaacuggauccagaaggagacccuggugaccuucaagaacccccacgccaagaagcaggacgucguggugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaaggucgugaaggagaucgccgagacccagcacggcaccaucgugauccggguccaguacgagggggacggcagccccugcaagauccccuucgagaucauggaccuggagaagcgcuacgugcucggccggcugaucaccgugaacccgaucgucacggagaaggacucccccgugaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcggggucuucacgagcaucggcaaggcccuccaccagguguucggggccaucuacggcgcggccuucuccggcgugagcuggaccaugaagauccugaucggggucaucaucaccuggaucggcaugaacucccggagcaccucccugagcgugucccuggugcucgucgggaucgugacgcuguaccugggcgugaugguccaggccgacagcgggugcgugguguccuggaagaacaaggagcucaagugcggcagcggcaucuucaucaccgacaacguccacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggaggucgaggacuacggguucggcguguucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgucaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgucaccgccggccacggccagguggacaacuucagccugggcgugcugggcauggcccucuuccuggaggagaugcugcggacccgcgucgggacgaagcacgcgauccuccugguggccguguccuucgucacccugaucaccggcaacaugagcuucaaggaccucgggcgggugguggucauggugggcgccaccauggccgacgacaucgggaugggcgugacguaccuggcccugcucgcggccuucaagguccgccccaccuucgccgccggccugcugcuccggaagcugaccuccaaggagcugaugaugaccacgaucgggaucgugcuccugagccaguccaccauccccgagaccgugcuggagcucaccgacgcccuggcgcugggcaugaugguccucaagaucgugcgcaacauggagaaguaccagcuggccgucacgaucauggccauccugugcgugccgaacgccgugauccuccagaacgccuggaaggucagcugcaccauccuggcggugguguccgucagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcaugguguccauccuggccagcucccuccugaagaacgacauccccaugaccggcccccuggucgccgggggccuccugaccgugugcuacgugcugaccgggcgcagcgccgaccucgagcuggagcgggccacggacgucaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggugaagaagcagcgggccgggguccucugggacgugcccagcccgccgcccaugggcaaggcggagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcgcuggagcccggcaagaacccccgggccgugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucguccgggaggccaucaagcgcgggcugcggacccugauccucgcgccgacccgcgugguggccgccgagauggaggaggcccugcggggccugcccauccgcuaccagacccccgccauccgggcggagcacacggggcgcgagaucgucgaccucaugugccacgccaccuucaccaugcgccugcugagccccgugcgggugccgaacuacaaccucaucaucauggacgaggcccacuucaccgaccccgccuccaucgccgcgcgcggcuacaucagcacgcgggucgagaugggcgaggccgccgggaucuucaugaccgccacgccgcccggcaaccgcgacccguucccccagagcaacgcccccaucaucgacgaggagcgggagauccccgagcgcuccuggaacagcgggcacgagugggugaccgacuucaagggcaagacggugugguucgucccguccaucaaggcggggaacgacaucgccgccugccugcggaagaacggcaagaaggugauccagcugagccgcaagaccuucgacuccgaguacgugaagacccggaucaacgacugggacuucgucgugaccacggacaucagcgagaugggcgccaacuucaaggcggagcgcgugaucgacccccggcgcugcaugaagcccgucauccucaccgacggggaggagcgggugauccuggccggccccaugccggugacccacuccagcgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgcgagaaggucgacgccaucgacggcgaguaccggcugcgcggggaggcccgcaagacguucguggaccucaugcggcgcggcgaccugcccguguggcuggccuacaaggucgccgcggaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacagcgacccccucgcccugaaggaguucaaggaguucgccgcgggccgcaagucccugacccucaaccugaucaccgagaugggccggcugcccacguucaugacccagaagacccgcgacgcccucgacaaccuggccgugcugcacaccgccgaggccggcgggcgggccuacaaccacgcccucagcgagcugcccgagacgcuggagacccuccugcugcucacccugcuggccaccgugaccggcgggaucuuccucuuccugauguccgggcgcgggaucgggaagaugacccuggggaugugcugcaucaucaccgccagcauccuccugugguacgcgcagauccagccgcacuggaucgccgccuccaucauccuggaguucuuccucaucguccugcugauccccgagcccgagaagcagcggacgccccaggacaaccagcucaccuacguggugaucgccauccugacggucguggccgcgaccauggccaacgagaugggcuuccuggagaagaccaagaaggaccucgggcugggcagcaucgccacccagcagccggaguccaacauccuggacaucgaccuccgccccgccagcgccuggacgcuguacgcgguggccaccaccuucgucacccccaugcugcggcacuccaucgagaacagcagcgugaacgugucccucacggccaucgccaaccaggccaccguccugaugggccuggggaagggcuggccccucagcaagauggacaucggggugccgcugcuggcgaucggcugcuacucccaggugaaccccaucacccucaccgccgcccugcugcuccuggucgcccacuacgcgaucaucgggcccggccugcaggccaaggccacgcgcgaggcccagaagcgggccgcggccggcaucaugaagaaccccaccguggacgggaucaccgugaucgaccucgacccgauccccuacgaccccaaguucgagaagcagcugggccaggucaugcugcucauccugugcgugacccaggugcugaugaugcgcacgaccugggcccucugcgaggcccugacccuggccaccgggcccaucagcacgcucugggagggcuccccggggcgguucuggaacaccaccaucgcggucagcauggccaacaucuuccgcggcuccuaccuggccggcgccgggcuccucuucagcaucaugaagaacaccacgaacacccggcgcggcaccgggaacaugggcgagacccugggcgagaaguggaagucccgccugaacgcccucgggaaguccgaguuccagaucuacaagaaguccggcauccaggagguggaccggacgcuggcgaaggaggggaucaagcgcggcgagaccgaccaccacgccgugagccggggguccgccaagcugcgcugguucgucgagcggaacauggugacccccgagggcaagguggucgaccucggcugcgggcgcggcggguggagcuacuacugcggcgggcugaagaacgugcgggaggugaagggccugaccaagggcgggcccggccacgaggagcccaucccgauguccacguacggguggaaccucguccgccugcagagcggcguggacguguucuucaucccgcccgagaagugcgacacccugcucugcgacaucggggaguccagccccaacccgaccgucgaggccggccggacccugcgcgugcugaaccucguggagaacuggcugaacaacaacacgcaguucugcaucaagguccugaaccccuacaugcccuccgugaucgagaagauggaggcgcugcagcggaaguacggcggggcccucgugcgcaacccgcugagccggaacagcacccacgagauguacugggucuccaacgccagcggcaacaucguguccagcgugaacaugaucucccgcaugcugaucaaccgguucaccaugcgccacaagaaggccaccuacgagcccgacgucgaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggugaacggcgugguccggcugcucaccaagccgugggacgugcugcccaccgugacccagauggccaugacggacaccacccccuucgggcagcagcgcgucuucaaggagaagguggacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggcgaucuucaccgacgagaacaaguggaaguccgcccgggaggccgucgaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgugagcaagaaggagggcggcgccauguacgccgacgacacggcggggugggacacccggaucacccucgaggaccugaagaacgaggagauggucaccaaccacauggagggcgagcacaagaagcuggccgaggccaucuucaagcucacguaccagaacaagguggugcgcguccagcggcccacgccccgggggaccgugauggacaucaucagccggcgcgaccagcggggcuccggccagguggggaccuacggccugaacacguucaccaacauggaggcccagcugauccgccagauggagggggagggcgucuucaagaacauccagcaccucaccgugaccgaggagguggccguccagaacuggcuggcgcggguggggcgcgagcgccugagccggauggccaucuccggcgacgacugcguggucaagccccucgacgaccgcuucgccaacgcccugacggcccugaacgacaugggcaagauccggaaggacauccagcagugggagccgagcaagggguggaacgacuggacccaggugcccuucugcucccaccacuuccacgagcucaucaugaaggacggccgcgugcuggucgugcccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccgugcccucccacugggucccgaccagccgcacgaccugguccauccacgccaagcacgaguggaugaccaccgaggacaugcugaccguguggaaccggguguggauccgcgagaaccccuggauggaggacaagacgcccgucgagagcugggaggagauccccuaccucggcaagcgggaggaccaguggugcgggucccugaucggccugaccagccgcgccaccugggcgaagaacauccagguggccaucaaccaggugcggucccucaucgggaacgaggaguacaccgacuacaugccgagcaugaagcgcuuccggcgcgaggaggaggaggccggcguccugugguga

SEQ ID NO: 9507 - RNA, 9876 nt, Artificial Sequence
  derived and/or modified CDS sequence (opt1) from DENV-2__EU660415__SS-prME
agcgccggcaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcaccccggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcgggcuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggggccgggccagcugaagcucaacugguucaagaagggguccagcaucggccagauguucgagaccaccaugcgcggcgcgaagcgcauggccauccugggggacaccgccugggacuucggcucccucggcgggguguucacgagcaucgggaaggcccuccaccaggucuucggcgccaucuacggcgcggccuucuccggggugagcuggaccaugaagauccugaucggcgugaucaucaccuggaucgggaugaacucccggagcaccucccugagcgucucccuggugcucgugggcaucgucacgcuguaccugggggugauggugcaggccgacagcggcugcgucguguccuggaagaacaaggagcucaagugcggcagcgggaucuucaucaccgacaacgugcacaccuggaccgagcaguacaaguuccagcccgagagccccuccaagcuggccagcgcgauccagaaggcccaggaggagggcaucugcgggauccgcuccgucacgcggcuggagaaccucauguggaagcagaucacccccgagcugaaccacauccuggccgagaacgaggugaagcucaccaucaugaccggcgacaucaaggggaucaugcaggccggcaagcgcagccugcggccgcagcccacggagcugaaguacuccuggaagaccuggggcaaggccaagaugcucagcaccgaguccuacaaccagaccuuccugaucgacgggcccgagacggcggagugcccgaacaccaaccgcgccuggaacagccuggagguggaggacuacggcuucggggucuucaccaccaacaucuggcucaagcugaaggagaagcaggacgccuucugcgacuccaagcugaugagcgccgccaucaaggacaaccgggcggugcacgccgacaugggcuacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccgggcccgugagccagcacaacuaccgccugggcuaccacacccagaucgcggggccguggcaccugggcaagcucgagauggacuucgacuucugcgacgggaccaccgugaucgucacggaggacugcggcaaccggggccccucccugcgcaccaccaccgccagcgggaagcugaucacggaguggugcugccggagcugcacccugccgccccugcgcuaccggggcgaggacgggugcugguacggcauggagauccgcccgcugaaggagaaggaggagaaccucgugaacucccuggugaccgccgggcacggccaggucgacaacuucagccugggcgugcucgggauggcccuguuccuggaggagaugcuccggacccgcgugggcacgaagcacgcgauccugcuggucgccguguccuucgugacccucaucaccgggaacaugagcuucaaggaccugggccgggucguggugauggucggggccaccauggccgacgacaucggcaugggcgugacguaccuggcccuccuggcggccuucaaggugcgccccaccuucgccgccgggcugcuccugcggaagcugaccuccaaggagcucaugaugaccacgaucggcaucguccugcugagccaguccaccauccccgagaccgugcucgagcugaccgacgcccuggcgcucgggaugauggugcugaagaucguccgcaacauggagaaguaccagcuggccgugacgaucauggccauccucugcguccccaacgccgugauccugcagaacgccuggaaggugagcugcaccauccuggcggucguguccgugagcccgcuccugcugaccuccagccagcagaagaccgacuggaucccccucgcccugacgaucaagggccugaaccccaccgccaucuuccucaccacccugucccgcacgaacaagaagcggagcuggccccugaacgaggccaucauggcggucggcaugguguccauccucgccagcucccugcugaagaacgacaucccgaugaccgggccccucguggccggcgggcugcugaccgucugcuacgugcucaccggccgcagcgccgaccuggagcuggagcgggccacggacgugaagugggaggaccaggcggagaucuccgggagcagccccauccucuccaucaccaucagcgaggacggcuccaugagcaucaagaacgaggaggaggagcagacccugaccauccugauccgcacgggccuccuggucaucuccgggcuguuccccaucagcaucccgaucaccgccgccgccugguaccucugggaggugaagaagcagcgggccggcgugcugugggacguccccagcccgccgcccauggggaaggcggagcuggaggacggcgccuaccgcaucaagcagaaggggauccucggcuacagccagaucggcgccgggguguacaaggagggcaccuuccacaccauguggcacgugacccgcggggcgguccugaugcacaagggcaagcgcaucgagcccuccugggccgacgugaagaaggaccugaucagcuacgggggcggcuggaagcucgagggggaguggaaggagggcgaggaggugcagguccuggcgcuggagcccgggaagaacccccgggccgugcagacgaagcccggccucuucaagaccaacaccgggaccaucggcgccgugucccuggacuucagccccggcacguccgggagccccaucaucgacaagaagggcaaggucguggggcuguacggcaacggcguggucacccgcuccggggccuacgugagcgccaucgcgcagaccgagaagggcaucgaggacaacccggagaucgaggacgacaucuuccggaagcgccggcugaccaucauggaccuccaccccggggccggcaagacgaagcgcuaccugcccgccaucgugcgggaggccaucaagcgcgggcugcggacccucauccuggcgcccacccgcgucguggccgccgagauggaggaggcccugcggggccucccgauccgcuaccagacccccgccauccgggcggagcacacgggccgcgagaucguggaccugaugugccacgccaccuucaccaugcgccugcucucccccguccgggugcccaacuacaaccugaucaucauggacgaggcccacuucaccgacccggccagcaucgccgcgcgcggguacaucuccacgcggguggagaugggcgaggccgccgggaucuucaugaccgccacgccgcccggcagccgcgaccccuucccgcagagcaacgcccccaucaucgacgaggagcgggagauccccgagcgcuccuggaacagcgggcacgagugggucaccgacuucaagggcaagacggugugguucgugcccuccaucaaggcgggcaacgacaucgccgccugccugcggaagaacgggaagaaggucauccagcucagccgcaagaccuucgacuccgaguacgugaagacccggaccaacgacugggacuucguggucacgaccgacaucagcgagaugggcgccaacuucaaggcggagcgcgugaucgacccgcggcgcugcaugaagcccgugauccugaccgacggggaggagcgggucauccuggccggccccaugcccgugacccacuccagcgccgcccagcgccgggggcgcaucggccggaacccgaagaacgagaacgaccaguacaucuacaugggcgagccccucgagaacgacgaggacugcgcccacuggaaggaggcgaagaugcugcuggacaacaucaacacgcccgaggggaucauccccuccauguucgagccggagcgcgagaagguggacgccaucgacggcgaguaccggcuccgcggggaggcccgcaagaccuucgucgaccugaugcggcgcggcgaccugcccguguggcucgccuacaagguggccgcggaggggaucaacuacgccgaccggcgcuggugcuucgacggcaucaagaacaaccagauccuggaggagaacgucgagguggagaucuggaccaaggagggcgagcggaagaagcugaagccccgcuggcucgacgcccggaucuacagcgacccgcuggcccugaaggaguucaaggaguucgccgcggggcgcaagucccucacccugaaccugaucacggagaugggccggcuccccaccuucaugacccagaagacccgcgacgcccuggacaaccuggccguccuccacacggccgaggccgggggccgggccuacaaccacgcccugagcgagcugcccgagacccucgagacccugcugcuccugacccugcucgccacggugaccggcgggaucuuccuguuccugauguccggccgcgggaucggcaagaugacccucgggaugugcugcaucaucaccgccagcauccugcugugguacgcgcagauccagccccacuggaucgccgccuccaucauccucgaguucuuccugaucgugcugcucaucccggagcccgagaagcagcggacgccccaggacaaccagcugacguacgucgugaucgccauccugaccguggucgccgcgaccauggccaacgagaugggcuuccucgagaagaccaagaaggacuucggccuggggagcaucgccacgcagcagcccgaguccaacauccuggacaucgaccuccgcccggccagcgccuggacccuguacgcgguggccaccaccuucgugacgcccaugcugcggcacuccaucgagaacagcagcgucaacgugucccucaccgccaucgccaaccaggccaccgugcugaugggccuggggaagggcuggccccucagcaagauggacaucggggucccccugcuggcgaucggcugcuacucccaggugaacccgaucacccucacggccgcccugcugcuccugguggcccacuacgcgaucaucggccccgggcugcaggccaaggccacccgcgaggcccagaagcgggccgcggccggcaucaugaagaaccccaccgucgacgggaucaccgugaucgaccucgaccccaucccguacgaccccaaguucgagaagcagcugggccaggugaugcugcucauccugugcgucacccaggugcugaugaugcgcaccaccugggcccucugcgaggcccugacccuggccacggggcccaucagcacccucugggagggcaaccccggccgguucuggaacaccaccaucgcgguguccauggccaacaucuuccgcgggagcuaccuggccggcgccgggcuccucuucuccaucaugaagaacacgaccaacacccggcgcggcaccggcaacaucggggagacgcugggcgagaaguggaagucccgccugaacgcccucggcaagagcgaguuccagaucuacaagaaguccgggauccaggaggucgaccggacccuggcgaaggaggggaucaagcgcggcgagaccgaccaccacgccgugucccggggcagcgccaagcugcgcugguucguggagcggaacauggucaccccggaggggaaggugguggaccucggcugcgggcgcggcgggugguccuacuacugcggcggccugaagaacguccgggaggugaaggggcugacgaagggcgggcccggccacgaggagcccauccccaugagcaccuacggguggaaccucgugcgccugcaguccggcgucgacguguucuucaucccgcccgagaagugcgacacccugcucugcgacaucggcgagagcucccccaaccccaccguggaggccgggcggacgcugcgcguccugaaccucguggagaacuggcugaacaacaacacccaguucugcaucaaggugcugaacccguacaugcccagcgucaucgagaagauggaggcgcugcagcggaaguacggcggggcccucgugcgcaacccccugucccggaacagcacccacgagauguacugggugagcaacgccuccggcaacaucgucagcuccgugaacaugaucagccgcaugcugaucaaccgguucaccaugcgccacaagaaggccaccuacgagccggacguggaccucggguccggcacgcggaacaucggcaucgagagcgagauccccaaccuggacaucaucgggaagcgcaucgagaagaucaagcaggagcacgagaccuccuggcacuacgaccaggaccaccccuacaagaccugggccuaccacggcagcuacgagaccaagcagacgggguccgcgagcuccauggucaacggcguggugcggcugcucaccaagcccugggacguccugccgaccgugacccagauggccaugacggacaccacccccuucggccagcagcgcguguucaaggagaaggucgacacccgcacgcaggagcccaaggaggggaccaagaagcugaugaagaucaccgccgaguggcucuggaaggagcugggcaagaagaagacgccccggaugugcacgcgcgaggaguucacccggaaggugcgcagcaacgccgcccugggggcgaucuucaccgacgagaacaaguggaaguccgcccgggaggccguggaggacagccgcuucugggagcucgucgacaaggagcggaaccugcaccuggagggcaagugcgagaccugcguguacaacaugauggggaagcgcgagaagaagcucggcgaguucggcaaggccaaggggucccgggccaucugguacauguggcugggcgcgcgcuuccuggaguucgaggcccucggguuccugaacgaggaccacugguucagccgggagaacucccugagcggcgucgagggggagggccuccacaagcugggcuacauccugcgcgacguguccaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggucgugcgcgugcagcggccgacgccccgcgggaccgucauggacaucaucagccggcgcgaccagcggggcagcggccagguggggaccuacggccugaacaccuucaccaacauggaggcccagcugauccgccagauggagggggagggcguguucaagaacauccagcaccucaccgucaccgaggagguggccgugcagaacuggcuggcgcgggucggccgcgagcgccugucccggauggccaucagcggggacgacugcguggugaagccccucgacgaccgcuucgccaacgcccugacggcccugaacgacaugggcaagauccggaaggacauccagcagugggagcccuccaagggguggaacgacuggacccaggucccguucugcagccaccacuuccacgagcucaucaugaaggacggccgcgugcuggugguccccugccggaaccaggacgagcugaucgggcgcgcgcggaucucccagggcgccggcuggagccuccgcgagaccgccugccuggggaaguccuacgcccagauguggagccugauguacuuccaccggcgcgaccuccggcuggccgcgaacgugaucugcuccgccgugcccagccacuggguccccaccucccgcacgaccuggagcauccacgccaagcacgaguggaugaccaccgaggacaugcugaccguguggaaccggguguggauccgcgagaacccguggauggaggacaagacgcccgucgaguccugggaggagauccccuaccucggcaagcgggaggaccaguggugcgggagccugaucggccugaccucccgcgccaccugggccaagaacauccaggcggccaucaaccaggugcggagccucaucgggaacgaggaguacaccgacuacaugcccuccaugaagcgcuuccggcgcgaggaggaggaggccggcgugcugugguga

SEQ ID NO: 9508 - RNA, 9876 nt, Artificial Sequence
  derived and/or modified CDS sequence (opt1) from DENV-2__EU687249__SS-prME
agcgcggggaugaucaucaugcugauccccaccgugauggccuuccaccucaccacccgcaacggggagccccacaugaucgucgggauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacauccucggccggcugaucaccgucaacccgaucgugacggagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccagguguucggggccaucuacggcgcggccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccgcgaggaggggaucugcggcauccgguccgugacgcgccuggagaaccucauguggaagcagaucacccccgagcugaaccacauccuggccgagaacgaggucaagcucaccaucaugaccggggacaucaagggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcguguucaccaccaacaucuggcucaagcugaaggagaagcaggacgccuucugcgacuccaagcugaugagcgccgccaucaaggacaaccgcgcgguccacgccgacaugggguacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgccggccccgucagccagcacaacuaccggccgggguaccacacccagaucgcgggccccuggcaccuggggaagcuggagauggacuucgacuucugcgacggcaccaccgugaucgugacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggucaacucccucgugaccgccggccacggccagguggacaacuucagccugggcguccugggcauggcccucuuccuggaggagaugcugcgcacccggguggggacgaagcacgcgauccuccugguggccgucuccuucaugacccugaucaccggcaacaugagcuucaaggaccucgggcgcgugguggucauggugggcgccaccauggccgacgacaucgggaugggcgugacguaccuggcccugcucgcggccuucaagguccggcccaccuucgccgccggccugcugcuccgcaagcugaccuccaaggagcugaugaugaccacgaucgggaucgugcuccugagccaguccaccauccccgagaccgugcuggagcucaccgacgcccuggcgcugggcaugaugguccucaagaucgugcgcaacauggagaaguaccagcuggccgugacgaucauggccauccugugcgucccgaacgccgugauccuccagaacgccuggaaggucagcugcaccauccuggcggugguguccgucagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggccaucauggcggugggcaugguguccauccuggccagcucccuccugaagaacgacauccccaugaccggcccccuggucgccgggggccuccugaccgugugcuacgugcugaccgggcggagcgccgaccucgagcuggagcgcgccacggacgucaagugggaggaccaggcggagaucuccggcagcagccccauccuguccaucaccaucagcgaggacggguccaugagcaucaagaacgaggaggaggagcagacccucaccauccugauccggacgggccugcucgugaucuccggccuguucccgaucagcauccccaucaccgccgccgccugguaccugugggaggugaagaagcagcgcgccgggguccucugggacgugcccagcccgccgcccaugggcaaggcggagcuggaggacggggccuaccggaucaagcagaagggcauccugggguacagccagaucggcgccggcguguacaaggaggggaccuuccacaccauguggcacgucacccgcggcgccgugcucaugcacaaggggaagcggaucgagcccuccugggccgacgugaagaaggaccugaucagcuacggcgggggcuggaagcuggagggcgaguggaaggagggggaggagguccaggugcucgcgcuggagcccggcaagaacccccgcgccgugcagacgaagcccgggcuguucaagaccaacaccggcaccaucggggccgucucccucgacuucagccccggcacguccggcagccccaucaucgacaagaaggggaagguggugggccuguacgggaacggcgucgugacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucguccgcgaggccaucaagcgggggcugcgcacccugauccucgcgccgacccgggugguggccgccgagauggaggaggcccugcgcggccugcccauccgguaccagacccccgccauccgcgcggagcacacggggcgcgagaucgucgaccucaugugccacgccaccuucaccaugcggcugcugagccccgugcgcgugccgaacuacaaccucaucaucauggacgaggcccacuucaccgaccccgccuccaucgccgcgcggggcuacaucagcacgcgcgucgagaugggcgaggccgccgggaucuucaugaccgccacgccgcccggcagccgggacccguucccccaguccaacgcccccaucaucgacgaggagcgcgagauccccgagcggagcuggaacuccgggcacgagugggugaccgacuucaagggcaagacggugugguucgucccgagcaucaaggcggggaacgacaucgccgccugccugcgcaagaacggcaagaaggugauccagcugucccggaagaccuucgacagcgaguacgugaagacccgcaccaacgacugggacuucgucgugacgaccgacaucuccgagaugggcgccaacuucaaggcggagcgggugaucgacccccgccggugcaugaagcccgucauccucaccgacggggaggagcgcgugauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaaggucgacgccaucgacggcgaguaccgccugcgcggggaggcccggaagaccuucguggaccucaugcgccggggcgaccugcccguguggcuggccuacaaggucgccgcggaggggaucaacuacgccgaccgccgguggugcuucgacggcaucaagaacaaccagauccucgaggagaacguggagguggagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccguccugcacacggccgaggccggcgggcgcgccuacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgccuccauccuccugugguacgcgcagauccagccgcacuggaucgccgccagcaucauccuggaguucuuccucaucguccugcugauccccgagcccgagaagcagcgcacgccccaggacaaccagcucacguacguggugaucgccauccugaccgucguggccgcgaccauggccaacgagaugggcuuccuggagaagaccaagaaggaccucgggcugggcuccaucgccacgcagcagccggagagcaacauccuggacaucgaccuccggcccgccuccgccuggacccuguacgcgguggccaccaccuucgucacgcccaugcugcgccacagcaucgagaacagcuccgugaacgugagccucaccgccaucgccaaccaggccaccguccugaugggccuggggaagggcuggccccucuccaagauggacaucggggugccgcugcuggcgaucggcugcuacagccaggugaaccccaucacccucacggccgcccugcugcuccuggucgcccacuacgcgaucaucgggcccggccugcaggccaaggccacccgggaggcccagaagcgcgccgcggccggcaucaugaagaaccccaccguggacgggaucaccgugaucgaccucgacccgauccccuacgaccccaaguucgagaagcagcugggccaggucaugcugcucauccugugcgugacccaggugcugaugaugcggaccaccugggcccucugcgaggcccugacccuggccacggggcccaucuccacccucugggagggcaacccggggcgcuucuggaacaccaccaucgcggucagcauggccaacaucuuccggggcuccuaccuggccggcgccgggcuccucuucagcaucaugaagaacacgaccaacacccgccgcggcaccgggaacaucggcgagacgcugggcgagaaguggaagucccggcugaacgcccucggcaagagcgaguuccagaucuacaagaaguccggcauccaggagguggaccgcacccuggcgaaggaggggaucaagcggggcgagaccgaccaccacgccgugagccgcggguccgccaagcugcggugguucgucgagcgcaacauggugacccccgagggccggguggucgaccucggcugcgggcgcggcggguggagcuacuacugcggcgggcugaagaacgugcgggaggugaagggccugacgaagggcgggcccggccacgaggagcccaucccgauguccaccuacggguggaaccucguccgccugcagagcggcguggacguguucuucaucccgcccgagaagugcgacacccugcucugcgacaucggggaguccagccccaacccgaccgucgaggccggccggacgcugcgcgugcugaaccucguggagaacuggcugaacaacaacacccaguucugcaucaagguccugaaccccuacaugcccuccgugaucgagaagauggaggcgcugcagcggaaguacggcggggcccucgugcgcaacccgcugagccggaacagcacccacgagauguacugggucuccaacgccagcggcaacaucguguccagcgugaacaugaucucccgcaugcugaucaaccgguucaccaugcgccacaagaaggccaccuacgagcccgacgucgaccucgggagcggcacgcggaacaucgggaucgaguccgaggugcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggugaacggcgucgugcgccugcucaccaagccgugggacgugcugcccaccgucacccagauggccaugacggacaccacccccuucgggcagcagcggguguucaaggagaagguggacacccgcacgcaggagcccaaggagggcaccaagaagcugaugaagaucaccgccgaguggcucuggaaggagcugggcaagaagaagaccccgcggaugugcacgcgcgaggaguucacccggaagguccgcuccaacgccgcccugggggcgaucuucaccgacgagaacaaguggaaguccgcccgggaggccguggaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgucagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggugguccgcgugcagcggcccacgccccgcgggaccgugauggacaucaucagccggcgcgaccagcggggcuccgggcaggucggcaccuacggccugaacacguucaccaacauggaggcccagcugauccgccagauggagggggagggcguguucaagaacauccagcaccucaccgugaccgaggaggucgccgugcagaacuggcuggcgcgcguggggcgggagcgccugagccggauggccaucuccggcgacgacugcgucgugaagccccucgacgaccgcuucgccaacgcccugacggcccugaacgacaugggcaagauccggaaggacauccagcagugggagccgagcaaggggugguccgacuggacccaggugcccuucugcagccaccacuuccacgagcucaucaugaaggacggccgcguccugguggugcccugccggaaccaggacgagcugaucgggcgcgcgcggaucucccagggcgccggguggagccuccgcgagaccgccugccugggcaaguccuacgcccagauguggagccugauguacuuccaccggcgcgaccuccggcuggccgcgaacgccaucugcuccgccguccccagccacugggugccgaccucccgcacgaccuggagcauccacgccaagcacgaguggaugaccaccgaggacaugcugaccguguggaaccgggucuggauccgcgagaaccccuggauggaggacaagacgcccguggaguccugggaggagauccccuaccucggcaagcgggaggaccaguggugcgggagccugaucggccugaccucccgcgccaccugggcgaagaacauccaggccgccaucaaccaggugcggagccucaucgggaacgaggaguacaccgacuacaugccgagcaugaagcgcuuccgccgggaggaggaggaggccggcguccugugguga

SEQ ID NO: 9509 - RNA, 9876 nt, Artificial Sequence
  derived and/or modified CDS sequence (opt1) from DENV-2__EU660416__SS-prME
agcgccgggaugaucaucaugcugauccccaccgugauggccuuccaccucaccacccgcaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagcgccgguacguccucggccgccugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcggauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccgcagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgguccgucacgcgccuggagaaccucauguggaagcagaucacccccgagcugaaccacauccuggccgagaacgaggugaagcucaccaucaugaccggggacaucaagggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggaugaagcacgcgauccuccuggucgccguguccuucgugacgcugaucaccggcaacaugagcuucaaggaccucgggcgcgucguggugauggucggcgccaccauggccgacgacaucgggaugggcgugaccuaccuggcccugcucgcggccuucaaggugcggcccacguucgccgccggccugcugcuccgcaagcugaccuccaaggagcugaugaugaccaccaucgggaucguccuccugagccaguccacgauccccgagaccgugcuggagcucaccgacgcccuggcgcugggcaugauggugcucaagaucguccgcaacauggagaaguaccagcuggccgugaccaucaugacgauccugugcgucccgaacgccgugauccuccagaacgccuggaaggugagcugcaccauccuggccgucguguccgugagcccccugcuccugaccuccagccggcagaagaccgacuggaucccccuggcgcucacgaucaaggggcugaaccccaccgccaucuuccugaccacccucucccgcacgaacaagaagcggagcuggccgcugaacgaggccaucauggccgucggcaugguguccauccuggcgagcucccuccugaagaacgacauccccaugaccggcccccugguggccgggggccuccugaccgucugcuacgugcugaccgggcgcagcgccgaccucgagcuggagcgggccacggacgugaagugggaggaccaggccgagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcccagaccgagaaguccaucgaggacaaccccgagaucgaggacgacaucuuccggaagcgccggcugaccaucauggaccugcaccccggggcgggcaagacgaagcgcuaccuccccgccaucgugcgggaggccaucaagcgcgggcugcggacccugauccucgccccgacccgcgucguggcggccgagauggaggaggcccugcggggccugcccauccgcuaccagacccccgccauccgcgccgagcacacggggcgggagaucguggaccucaugugccacgcgaccuucaccaugcgccugcugagccccguccgggugccgaacuacaaccucaucaucauggacgaggcccacuucaccgaccccgccuccaucgccgcccgcggcuacaucagcacgcggguggagaugggcgaggcggccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggccgggaacgacaucgcggccugccugcggaagaacggcaagaaggucauccagcugucccgcaagaccuucgacagcgaguacgugaagacccggaccaacgacugggacuucguggucacgaccgacaucuccgagaugggcgccaacuucaaggccgagcgcgugaucgacccccggcgcugcaugaagcccgugauccucaccgacggggaggagcgggucauccuggcgggccccaugccggugacccacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacgcccgagggcaucaucccgagcauguucgagcccgagcgcgagaagguggacgcgaucgacggcgaguaccgccugcgcggggaggcccgcaagaccuucgucgaccucaugcggcgcggcgaccugcccguguggcuggccuacaagguggccgccgaggggaucaacuacgcggaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgccggccgcaagagccugacccucaaccugaucacggagaugggccggcugcccaccuucaugacccagaagacccgcgacgcgcucgacaaccuggccguccugcacacggccgaggccgggggccgggcguacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucacguacgucgugaucgccauccugaccguggucgccgccaccauggcgaacgagaugggcuuccuggagaagaccaagaaggaccucgggcugggcuccaucgccacgcagcagccggagagcaacauccuggacaucgaccuccgccccgccuccgccuggacccuguacgccguggcgaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggccaucggcugcuacagccaggugaaccccaucacccucacggcggcccugcugcuccugguggcccacuacgccaucaucgggcccggccugcaggcgaaggccacccgcgaggcccagaagcgggccgccgcgggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgccgugagcauggcgaacaucuuccgcggcuccuaccuggccggcgccgggcuccucuucagcaucaugaagaacacgaccaacacccgccggggcaccgggaacaugggcgagacgcugggcgagaaguggaagucccgccugaacgcccucgggaaguccgaguuccagaucuacaagaaguccggcauccaggaggucgaccggacccuggccaaggaggggaucaagcgcggcgagaccgaccaccacgcggugagccggggguccgccaagcugcgcugguucguggagcggaacauggucacccccgagggcaaggugguggaccucggcugcgggcgcggcggguggagcuacuacugcggcgggcugaagaacguccgggaggugaagggccugacgaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgaccguggaggccggccggacgcugcgcguccugaaccucguggagaacuggcugaacaacaacacccaguucugcaucaaggugcugaaccccuacaugcccuccgucaucgagaagauggaggcccugcagcggaaguacggcggggcgcucgugcgcaacccgcugagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggucaacggcguggugcgccugcucaccaagccgugggacguccugcccaccgugacccagauggcgaugacggacaccacccccuucgggcagcagcggguguucaaggagaaggucgacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggccaucuucaccgacgagaacaaguggaaguccgcgcgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcccgcuuccuggaguucgaggcgcucggguuccugaacgaggaccacugguucucccgggagaacagccuguccggcgucgagggggagggccuccacaagcugggguacauccugcgcgacgugagcaagaaggagggcggcgccauguacgccgacgacacggccgggugggacacccggaucacccucgaggaccugaagaacgaggagauggugaccaaccacauggagggcgagcacaagaagcuggcggaggccaucuucaagcucacguaccagaacaaggucgugcgcgugcagcggcccacgccccgggggaccgucauggacaucaucagccggcgcgaccagcggggcuccggccaggugggcaccuacggccugaacacguucaccaacauggaggcccagcugauccgccagauggagggggagggcguguucaagaacauccagcaccucaccgucaccgaggagguggccgugcagaacuggcuggcccgcgucgggcgggagcgccugagccggauggcgaucuccggcgacgacugcguggugaagccccucgacgaccgcuucgccaacgcccugacggcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcccggaucagccagggcgcgggguggucccuccgcgagaccgccugccugggcaagagcuacgcccagauguggucccugauguacuuccaccggcgcgaccuccggcuggccgccaacgcgaucugcagcgccgugcccucccacugggugccgaccagccgcacgaccugguccauccacgccaagcacgaguggaugaccaccgaggacaugcugaccgucuggaacaagguguggauccgggagaaccccuggauggaggacaagacgcccguggagagcugggaggagauccccuaccucggcaagcgcgaggaccaguggugcgggucccugaucggccugaccagccgggccaccugggccaagaacauccaggcggccaucaaccagguccgcucccucaucgggaacgaggaguacaccgacuacaugccgagcaugaagcgguuccgccgcgaggaggaggaggccggcgugcugugguga

SEQ ID NO: 9510 - RNA, 9876 nt, Artificial Sequence
  derived and/or modified CDS sequence (opt1) from DENV-2__EU660417__SS-prME
agcgccgggaugaucaucaugcugauccccaccgugauggccuuccaccucaccacccgcaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagcgccgguacguccucggccgccugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcggauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccgcagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgguccgucacgcgccuggagaaccucauguggaagcagaucacccccgagcugaaccacauccuggccgagaacgaggugaagcucaccaucaugaccggggacaucaagggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucaugaccauccugugcgucccgaacgccgugauccuccagaacgccuggaaggugagcugcaccauccuggccgucguguccgugagcccccugcuccugaccuccagccggcagaagacggacuggaucccccuggcgcucaccaucaaggggcugaaccccaccgccaucuuccugaccacgcucucccgcaccaacaagaagcggagcuggccgcugaacgaggccaucauggccgucggcaugguguccauccuggcgagcucccuccugaagaacgacauccccaugaccggcccccugguggccgggggccuccugaccgucugcuacgugcugacggggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacccucacgauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguacaaggaggggaccuuccacaccauguggcacgugacgcggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgcuccggcgccuacgugagcgccaucgcccagaccgagaaguccaucgaggacaaccccgagaucgaggacgacaucuuccggaagcgccggcugacgaucauggaccugcaccccggggcgggcaagaccaagcgcuaccuccccgccaucgugcgggaggccaucaagcgcgggcugcggacccugauccucgccccgacccgcgucguggcggccgagauggaggaggcccugcggggccugcccauccgcuaccagacgcccgccauccgcgccgagcacaccgggcgggagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggcgaggcggccgggaucuucaugaccgccacgccgcccggcagccgcgacccguucccccaguccaacgcccccaucaucgacgaggagcgggagauccccgagcgcagcuggaacuccgggcacgagugggucacggacuucaagggcaagaccgugugguucgugccgagcaucaaggccgggaacgacaucgcggccugccugcggaagaacggcaagaaggucauccagcugucccgcaagaccuucgacagcgaguacgugaagacccggacgaacgacugggacuucguggucaccaccgacaucuccgagaugggcgccaacuucaaggccgagcgcgugaucgacccccggcgcugcaugaagcccgugauccucaccgacggggaggagcgggucauccuggcgggccccaugccggugacgcacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgcgaucgacggcgaguaccgccugcgcggggaggcccgcaagaccuucgucgaccucaugcggcgcggcgaccugcccguguggcuggccuacaagguggccgccgaggggaucaacuacgcggaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgccggccgcaagagccugacgcucaaccugaucaccgagaugggccggcugcccaccuucaugacccagaagacgcgcgacgcgcucgacaaccuggccguccugcacaccgccgaggccgggggccgggcguacaaccacgcccucuccgagcugcccgagacccuggagacccuccugcugcucacgcugcuggccaccgugaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugaccguggucgccgccaccauggcgaacgagaugggcuuccuggagaagacgaagaaggaccucgggcugggcuccaucgccacccagcagccggagagcaacauccuggacaucgaccuccgccccgccuccgccuggacccuguacgccguggcgaccacguucgugacccccaugcugcggcacagcaucgagaacagcuccgucaacgugagccucaccgccaucgccaaccaggccaccgugcugaugggccuggggaagggcuggccccucuccaagauggacaucggggucccgcugcuggccaucggcugcuacagccaggugaaccccaucacgcucaccgcggcccugcugcuccugguggcccacuacgccaucaucgggcccggccugcaggcgaaggccacccgcgaggcccagaagcgggccgccgcgggcaucaugaagaaccccaccgucgacgggaucacggugaucgaccucgacccgauccccuacgaccccaaguucgagaagcagcugggccaggugaugcugcucauccugugcgucacccaggugcugaugaugcgcaccaccugggcccucugcgaggcccugacgcuggccaccgggcccaucuccacccucugggagggcagcccggggcgguucuggaacaccacgaucgccguguccauggcgaacaucuuccgcggcagcuaccuggccggcgccgggcuccucuucuccaucaugaagaacaccaccaacacccgccggggcacggggaacaugggcgagacccugggcgagaaguggaagucccgccugaacgcccucgggaaguccgaguuccagaucuacaagaaguccggcauccaggaggucgaccggacccuggccaaggaggggaucaagcgcggcgagaccgaccaccacgcggugucccgggggagcgccaagcugcgcugguucguggagcggaacauggucacgcccgagggcaaggugguggaccucggcugcgggcgcggcgggugguccuacuacugcggcgggcugaagaacguccgggaggugaagggccugaccaagggcgggcccggccacgaggagcccaucccgaugagcaccuacggguggaaccucgugcgccugcaguccggcgucgacguguucuucaucccgcccgagaagugcgacacccugcucugcgacaucggggagagcucccccaacccgacgguggaggccggccggacccugcgcguccugaaccucguggagaacuggcugaacaacaacacccaguucugcaucaaggugcugaaccccuacaugcccagcgucaucgagaagauggaggcccugcagcggaaguacggcggggcgcucgugcgcaacccgcugagccggaacuccacccacgagauguacugggugagcaacgccuccggcaacaucgucagcuccgugaacaugaucagccgcaugcugaucaaccgguucaccaugcgccacaagaaggccacguacgagcccgacguggaccucggguccggcacccggaacaucgggaucgagagcgagauccccaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggucaacggcguggugcgccugcucaccaagccgugggacguccugcccaccgugacgcagauggcgaugaccgacaccacccccuucgggcagcagcggguguucaaggagaaggucgacacgcgcacccaggagcccaaggagggcaccaagaagcugaugaagaucaccgccgaguggcucuggaaggagcugggcaagaagaagacgccgcggaugugcacccgcgaggaguucacccggaaggugcgcagcaacgccgcccugggggccaucuucaccgacgagaacaaguggaaguccgcgcgggaggccguggaggacagccgcuucugggagcucgucgacaaggagcggaaccugcaccuggagggcaagugcgagacgugcguguacaacaugauggggaagcgcgagaagaagcucggcgaguucgggaaggccaagggcucccgggccaucugguacauguggcugggcgcccgcuuccuggaguucgaggcgcucggguuccugaacgaggaccacugguucagccgggagaacucccugagcggcgucgagggggagggccuccacaagcugggguacauccugcgcgacgugagcaagaaggagggcggcgccauguacgccgacgacaccgccgggugggacacccggaucacccucgaggaccugaagaacgaggagauggugacgaaccacauggagggcgagcacaagaagcuggcggaggccaucuucaagcucaccuaccagaacaaggucgugcgcgugcagcggcccacgccccgggggaccgucauggacaucaucucccggcgcgaccagcggggcagcggccaggugggcacguacggccugaacaccuucaccaacauggaggcccagcugauccgccagauggagggggagggcguguucaagaacauccagcaccucaccgucacggaggagguggccgugcagaacuggcuggcccgcgucgggcgggagcgccugucccggauggcgaucagcggcgacgacugcguggugaagccccucgacgaccgcuucgccaacgcccugaccgcccugaacgacaugggcaagauccggaaggacauccagcagugggagccguccaagggguggaacgacuggacccagguccccuucugcagccaccacuuccacgagcucaucaugaaggacggccgcgugcuggugguccccugccggaaccaggacgagcugaucgggcgcgcccggaucucccagggcgcgggguggagccuccgcgagaccgccugccugggcaaguccuacgcccagauguggagccugauguacuuccaccggcgcgaccuccggcuggccgccaacgcgaucugcuccgccgugcccagccacugggugccgacgucccgcaccaccuggagcauccacgccaagcacgaguggaugaccaccgaggacaugcugacggucuggaacaagguguggauccgggagaaccccuggauggaggacaagacccccguggaguccugggaggagauccccuaccucggcaagcgcgaggaccaguggugcgggagccugaucggccugaccucccgggccaccugggccaagaacauccaggcggccaucaaccagguccgcagccucaucgggaacgaggaguacacggacuacaugccgagcaugaagcgguuccgccgcgaggaggaggaggccggcgugcugugguga

SEQ ID NO: 9511 - RNA, 9876 nt, Artificial Sequence
  derived and/or modified CDS sequence (opt1) from DENV-2__EU677137__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggaugagcagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccagcaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugacggucaccgaggacugcgggucccggggccccagccuccgcaccaccacggccagcggcaagcugaucaccgaguggugcugccgguccugcacccugcccccgcuccgcuaccgcggggaggacggcugcugguacgggauggagauccgcccccugaaggagaaggaggagaaccuggugaacagccucgugaccgccggccacgggcaggucgacaacuucucccugggcgugcugggcauggcccucuuccuggaggagaugcugcggacgcgcguggggaccaagcacgcgauccuccuggucgccgugagcuucgugacccugaucaccggcaacauguccuucaaggaccucgggcgggucguggugauggucggcgccacgauggccgacgacaucgggaugggcgugaccuaccuggcccugcucgcggccuucaaggugcgccccaccuucgccgccggccugcugcuccggaagcugaccagcaaggagcugaugaugacgaccaucgggaucguccuccugucccagagcaccauccccgagaccgugcuggagcucacggacgcccuggcgcugggcaugauggugcucaagaucguccgcaacauggagaaguaccagcuggccgugaccaucauggccauccugugcgucccgaacgccgugauccuccagaacgccuggaagguguccugcaccauccuggcggucgugagcgugagcccccugcuccugaccagcucccagcagaagacggacuggaucccccuggcccucaccgucaaggggcugaaccccaccgccaucuuccugaccacgcucagccgcaccaacaagaagcgguccuggccgcugaacgaggccaucauggcggugggcauggugagcauccuggccuccagccuccugaagaacgacauccccaugaccggcccccuggucgccgggggccuccugaccgugugcuacgugcugacggggcgcuccgccgaccucgagcuggagcgggccaccgacgucaagugggaggaccaggcggagaucagcggcagcucccccauccugagcaucaccaucuccgaggacgggagcauguccaucaagaacgaggaggaggagcagacccucacgauccugauccgcaccggccugcucgugaucagcggccuguucccgaucuccauccccaucaccgccgccgccugguaccugugggaggugaagaagcagcgggccgggguccucugggacgugcccuccccgccgcccaugggcaaggcggagcuggaggacggggccuaccgcaucaagcagaagggcauccugggguacucccagaucggcgccggcguguacaaggaggggaccuuccacaccauguggcacgucacgcggggcgccgugcucaugcacaaggggaagcgcaucgagcccagcugggccgacgugaagaaggaccugaucuccuacggcgggggcuggaagcuggagggcgaguggaaggagggggaggagguccaggugcucgcgcuggagcccggcaagaacccccgggccgugcagaccaagcccgggcuguucaagaccaacaccggcacgaucggggccgucagccucgacuucucccccggcaccagcggcucccccaucaucgacaagaaggggaagguggugggccuguacgggaacggcgucgugacccgcagcggcgccuacguguccgccaucgcgcagaccgagaaguccaucgaggacaaccccgagaucgaggacgacaucuuccggaagcgccggcugacgaucauggaccugcaccccggggccggcaagaccaagcgcuaccuccccgccaucguccgggaggccaucaagcgcgggcugcggacccugauccucgcgccgacccgcgugguggccgccgagauggaggaggcccugcggggccugcccauccgcuaccagacgcccgccauccgggcggagcacaccgggcgcgagaucgucgaccucaugugccacgccaccuucaccaugcgccugcugucccccgugcgggugccgaacuacaaccucaucaucauggacgaggcccacuucacggaccccgccagcaucgccgcgcgcggcuacaucagcacccgggucgagaugggcgaggccgccgggaucuucaugaccgccacgccgcccggcucccgcgacccguucccccagagcaacgcccccaucaucgacgaggagcgggagauccccgagcgcuccuggaacagcgggcacgagugggugacggacuucaagggcaagaccgugugguucgucccguccaucaaggcggggaacgacaucgccgccugccugcggaagaacggcaagaaggugauccagcugagccgcaagaccuucgacuccgaguacgugaagacccggacgaacgacugggacuucgucgugaccaccgacaucagcgagaugggcgccaacuucaaggcggagcgcgugaucgacccccggcgcugcaugaagcccgucauccucaccgacggggaggagcgggugauccuggccggccccaugccggugacgcacuccagcgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgcgagaaggucgacgccaucgacggcgaguaccggcugcgcggggaggcccgcaagaccuucguggaccucaugcggcgcggcgaccugcccguguggcuggccuacaaggucgccgcggaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacagcgacccccucgcccugaaggaguucaaggaguucgccgcgggccgcaagucccugacgcucaaccugaucaccgagaugggccggcugcccaccuucaugacccagaagacgcgcgacgcccucgacaaccuggccgugcugcacaccgccgaggccggcgggcgggccuacaaccacgcccucagcgagcugcccgagacccuggagacccuccugcugcucacgcugcuggccaccgugaccgggggcaucuuccucuuccugauguccggccgcgggaucggcaagaugacccuggggaugugcugcaucaucaccgccagcauccuccugugguacgcgcagauccagccgcacuggaucgccgccuccaucauccuggaguucuuccucaucguccugcugauccccgagcccgagaagcagcggacgccccaggacaaccagcucaccuacguggugaucgccauccugaccgucguggccgcgaccauggccaacgagaugggcuuccuggagaagacgaagaaggaccucgggcugggcagcaucgccacccagcagccggaguccaacauccuggacaucgaccuccgccccgccagcgccuggacccuguacgcgguggccaccacguucgucacccccaugcugcggcacagcaucgagaacuccagcgugaacgugucccucaccgccaucgccaaccaggccaccguccugaugggccuggggaagggcuggccccucagcaagauggacaucggggugccgcugcuggcgaucggcugcuacucccaggugaaccccaucacgcucaccgccgcccugcugcuccuggucgcccacuacgcgaucaucgggcccggccugcaggccaaggccacccgcgaggcccagaagcgggccgcggccggcaucaugaagaaccccaccguggacgggaucacggugaucgaccucgacccgauccccuacgaccccaaguucgagaagcagcugggccaggucaugcugcucauccugugcgugacccaggugcugaugaugcgcaccaccugggcccucugcgaggcccugacgcuggccaccgggcccaucagcacccucugggagggcaacccggggcgguucuggaacaccacgaucgcggucuccauggccaacaucuuccgcggcagcuaccuggccggcgccgggcuccucuucuccaucaugaagaacaccaccaacacccggcgcggcacggggaacaugggcgagacccugggcgagaaguggaagucccgccugaacgcccucgggaaguccgaguuccagaucuacaagaaguccggcauccaggagguggaccggacccuggcgaaggaggggaucaagcgcggcgagaccgaccaccacgccgugucccgggggagcgccaagcugcgcugguucgucgagcggaacauggugacgcccgagggcaagguggucgaccucggcugcgggcgcggcgggugguccuacuacugcggcgggcugaagaacgugcgggaggugaagggccugaccaagggcgggcccggccacgaggagcccaucccgaugagcaccuacggguggaaccucguccgccugcaguccggcguggacguguucuucaucccgcccgagaagugcgacacccugcucugcgacaucggggagagcucccccaacccgacggucgaggccggccggacccugcgcgugcugaaccucguggagaacuggcugaacaacaacacccaguucugcaucaagguccugaaccccuacaugcccagcgugaucgagaagauggaggcgaugcagcggaaguacggcggggcccuggugcgcaacccgcucagccggaacuccacccacgagauguacugggucagcaacgccuccggcaacaucgugagcuccgugaacaugaucagccgcaugcugaucaaccgguucaccaugcgccacaagaaggccacguacgagcccgacgucgaccugggguccggcacccggaacaucgggaucgagagcgagauccccaaccucgacaucaucggcaagcgcaucgagaagaucaagcaggagcacgagaccuccuggcacuacgaccaggaccaccccuacaagaccugggccuaccacggcagcuacgagacgaagcagaccggguccgcgagcuccauggugaacggcgugguccggcugcugaccaagccgugggacgugcuccccaccgugacgcagauggccaugaccgacaccacccccuucgggcagcagcgcgucuucaaggagaagguggacacgcgcacccaggagcccaaggagggcaccaagaagcugaugaagaucaccgccgaguggcuguggaaggagcucggcaagaagaagacgccgcggaugugcacccgcgaggaguucacccggaaggugcgcagcaacgccgcccugggggcgaucuucaccgacgagaacaaguggaaguccgcccgggaggccgucgaggacagccgcuucugggagcugguggacaaggagcggaaccuccaccuggagggcaagugcgagacgugcgucuacaacaugauggggaagcgcgagaagaagcugggcgaguucgggaaggccaagggcucccgggccaucugguacauguggcucggcgcgcgcuuccuggaguucgaggcccugggguuccucaacgaggaccacugguucagccgggagaacucccugagcggcguggagggggagggccugcacaagcucggguacauccugcgcgacgugagcaagaaggagggcggcgccauguacgccgacgacaccgcggggugggacacccggaucacccuggaggaccucaagaacgaggagauggucacgaaccacauggagggcgagcacaagaagcuggccgaggccaucuucaagcugaccuaccagaacaagguggugcgcguccagcggcccacgccccgggggaccgugauggacaucaucucccggcgcgaccagcggggcagcggccagguggggacguacggccucaacaccuucaccaacauggaggcccagcugauccgccagauggagggggagggcgucuucaagaacauccagcaccugaccgugacggaggagguggccguccagaacuggcucgcgcggguggggcgcgagcgccugucccggauggccaucagcggcgacgacugcguggucaagccccuggacgaccgcuucgccaacgcccucaccgcccugaacgacaugggcaagauccggaaggacauccagcagugggagccguccaagggguggaacgacuggacccaggugcccuucugcagccaccacuuccacgagcugaucaugaaggacggccgcgugcucgucgugcccugccggaaccaggacgagcugaucgggcgcgcgcggaucucccagggcgccggguggagccugcgcgagaccgccugccucggcaaguccuacgcccagauguggagccugauguacuuccaccggcgcgaccugcggcucgccgcgaacgccaucugcuccgccgugcccagccacugggucccgacgucccgcaccaccuggagcauccacgccaagcacgaguggaugaccaccgaggacaugcugacgguguggaaccggguguggauccgcgagaaccccuggauggaggacaagacccccgucgaguccugggaggagauccccuaccugggcaagcgggaggaccaguggugcgggagccucaucggccugaccucccgcgccaccugggcgaagaacauccaggccgccaucaaccaggugcggagccugaucgggaacgaggaguacacggacuacaugccgagcaugaagcgcuuccggcgcgaggaggaggaggccggcgugcucugguga

SEQ ID NO: 9512 - RNA, 9876 nt, Artificial Sequence
  derived and/or modified CDS sequence (opt1) from DENV-2__EU677138__SS-prME
agcgcggggaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggccgcgcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccgggucguggccgccgagauggaggaggcccugcgcggccugcccauccgguaccagacccccgccauccgcgcggagcacacggggcgcgagaucguggaccucaugugccacgccaccuucaccaugcggcugcugagccccguccgcgugccgaacuacaaccucaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagacggugugguucgugccgagcaucaaggcggggaacgacaucgccgccugccugcgcaagaacggcaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccucaccgacggggaggagcgcgucauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaagguggacgccaucgacggcgaguaccgccugcgcggggaggcccggaagaccuucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccguccugcacacggccgaggccggcgggcgcgccuacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccggcccgccuccgccuggacccuguacgcgguggccaccaccuucgugacgcccaugcugcgccacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgggaggcccagaagcgcgccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacggggcccaucuccacccucugggagggcaacccggggcgcuucuggaacaccaccaucgcggugagcauggccaacaucuuccggggcuccuaccuggccggcgccgggcuccucuucagcaucaugaagaacacgaccaacacccgccgcggcaccgggaacaugggcgagacgcugggcgagaaguggaagucccggcugaacgcccucggcaagagcgaguuccagaucuacaagaaguccggcauccaggaggucgaccgcacccuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugacgaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgaccguggaggccggccgcacgcugcggguccugaaccucguggagaacuggcugaacaacaacacccaguucugcaucaaggugcugaaccccuacaugcccuccgucaucgagaagauggaggcgcugcagcgcaaguacggcggggcccucgugcggaacccgcugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacgcgcaacaucgggaucgaguccgagacccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgcguccagcauggucaacggcguggugcgccugcucaccaagccgugggacguccugcccaccgugacgcagauggccaugaccgacaccacccccuucgggcagcagcgcguguucaaggagaaggucgacacgcggacccaggagcccaaggagggcaccaagaagcugaugaagaucaccgccgaguggcucuggaaggagcugggcaagaagaagacgccgcgcaugugcacccgggaggaguucacccgcaaggugcgguccaacgccgcccugggggcgaucuucaccgacgagaacaaguggaaguccgcccgcgaggccguggaggacucccgguucugggagcucgucgacaaggagcgcaaccugcaccuggagggcaagugcgagacgugcguguacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcgucgagggggagggccuccacaagcugggguacauccugcgggacgugagcaagaaggagggcggcgccauguacgccgacgacaccgcggggugggacacccgcaucacccucgaggaccugaagaacgaggagauggugacgaaccacauggagggcgagcacaagaagcuggccgaggccaucuucaagcucaccuaccagaacaaggucgugcgggugcagcgccccacgccccgggggaccgucauggacaucaucagccgccgggaccagcgcggcuccggccagguggggacguacggccugaacaccuucaccaacauggaggcccagcugauccggcagauggagggggagggcguguucaagaacauccagcaccucaccgccacggaggaggucgcggugcagaacuggcuggcccgcguggggcgcgagcggcugagccgcauggccaucuccggcgacgacugcgucgugaagccccucgacgaccgguucgccaacgcccugaccgcgcugaacgacaugggcaagauccgcaaggacauccagcagugggagccgagcaagggguggaacgacuggacccaggugcccuucugcucccaccacuuccacgagcucaucaugaaggacggccggguccugguggugcccugccgcaaccaggacgagcugaucgggcgggcccgcaucagccagggcgccggguggucccuccgggagaccgccugccugggcaagagcuacgcccagauguggucccugauguacuuccaccgccgggaccuccgccuggcggccaacgccaucugcagcgccguccccucccacugggugccgacgagccggaccaccugguccauccacgccaagcacgaguggaugaccaccgaggacaugcugacgguguggaaccgcgucuggauccgggagaaccccuggauggaggacaagacccccguggagagcugggaggagauccccuaccucggcaagcgcgaggaccaguggugcgggucccugaucggccugaccagccgggcgaccugggccaagaacauccagguggccaucaaccagguccgcucccucaucgggaacgaggaguacacggacuacaugccgagcaugaagcgguuccgccgcgaggaggaggaggccggcgugcugugguga

SEQ ID NO: 9513 - RNA, 9876 nt, Artificial Sequence
  derived and/or modified CDS sequence (opt1) from DENV-2__EU677149__SS-prME
agcgccgggaugaucaucaugcugauccccaccgugauggccuuccaccucaccacccgcaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagcgccgguacguccucggccgccugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcggauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccgcagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgguccgucacgcgccuggagaaccucauguggaagcagaucacccccgagcugaaccacauccuggccgagaacgaggugaagcucaccaucaugaccggggacaucaagggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucaugaccauccugugcgucccgaacgccgugauccuccagaacgccuggaaggugagcugcaccauccuggccgucguguccgugagcccccugcuccugaccuccagccggcagaagacggacuggaucccccuggcgcucaccaucaaggggcugaaccccaccgccaucuuccugaccacgcucucccgcaccaacaagaagcggagcuggccgcugaacgaggccaucauggccgucggcaugguguccauccuggcgagcucccuccugaagaacgacauccccaugaccggcccccugguggccgggggccuccugaccgucugcuacgugcugacggggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacccucacgauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguacaaggaggggaccuuccacaccauguggcacgugacgcggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgcuccggcgccuacgugagcgccaucgcccagaccgagaaguccaucgaggacaaccccgagaucgaggacgacaucuuccggaagcgccggcugacgaucauggaccugcaccccggggcgggcaagaccaagcgcuaccuccccgccaucgugcgggaggccaucaagcgcgggcugcggacccugauccucgccccgacccgcgucguggcggccgagauggaggaggcccugcggggccugcccauccgcuaccagacgcccgccauccgcgccgagcacaccgggcgggagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggcgaggcggccgggaucuucaugaccgccacgccgcccggcagccgcgacccguucccccaguccaacgcccccaucaucgacgaggagcgggagauccccgagcgcagcuggaacuccgggcacgagugggucacggacuucaagggcaagaccgugugguucgugccgagcaucaaggccgggaacgacaucgcggccugccugcggaagaacggcaagaaggucauccagcugucccgcaagaccuucgacagcgaguacgugaagacccggacgaacgacugggacuucguggucaccaccgacaucuccgagaugggcgccaacuucaaggccgagcgcgugaucgacccccggcgcugcaugaagcccgugauccucaccgacggggaggagcgggucauccuggcgggccccaugccggugacgcacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgcgaucgacggcgaguaccgccugcgcggggaggcccgcaagaccuucgucgaccucaugcggcgcggcgaccugcccguguggcuggccuacaagguggccgccgaggggaucaacuacgcggaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgccggccgcaagagccugacgcucaaccugaucaccgagaugggccggcugcccaccuucaugacccagaagacgcgcgacgcgcucgacaaccuggccguccugcacaccgccgaggccgggggccgggcguacaaccacgcccucuccgagcugcccgagacccuggagacccuccugcugcucacgcugcuggccaccgugaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugaccguggucgccgccaccauggcgaacgagaugggcuuccuggagaagacgaagaaggaccucgggcugggcuccaucgccacccagcagccggagagcaacauccuggacaucgaccuccgccccgccuccgccuggacccuguacgccguggcgaccacguucgugacccccaugcugcggcacagcaucgagaacagcuccgucaacgugagccucaccgccaucgccaaccaggccaccgugcugaugggccuggggaagggcuggccccucuccaagauggacaucggggucccgcugcuggccaucggcugcuacagccaggugaaccccaucacgcucaccgcggcccugcugcuccugguggcccacuacgccaucaucgggcccggccugcaggcgaaggccacccgcgaggcccagaagcgggccgccgcgggcaucaugaagaaccccaccgucgacgggaucacggugaucgaccucgacccgauccccuacgaccccaaguucgagaagcagcugggccaggugaugcugcucauccugugcgucacccaggugcugaugaugcgcaccaccugggcccucugcgaggcccugacgcuggccaccgggcccaucuccacccucugggagggcaacccggggcgguucuggaacaccacgaucgccgugagcauggcgaacaucuuccgcggcuccuaccuggccggcgccgggcuccucuucagcaucaugaagaacaccaccaacacccgccggggcacggggaacaugggcgagacccugggcgagaaguggaagucccgccugaacgcccucgggaaguccgaguuccagaucuacaagaaguccggcauccaggaggucgaccggacccuggccaaggaggggaucaagcgcggcgagaccgaccaccacgcggugagccggggguccgccaagcugcgcugguucguggagcggaacauggucacgcccgagggcaaggugguggaccucggcugcgggcgcggcggguggagcuacuacugcggcgggcugaagaacguccgggaggugaagggccugaccaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgacgguggaggccggccggacccugcgcguccugaaccucguggagaacuggcugaacaacaacacccaguucugcaucaaggugcugaaccccuacaugcccuccgucaucgagaagauggaggcccugcagcggaaguacggcggggcgcucgugcgcaacccgcugagccggaacagcacccacgagauguacuggguguccaacgccagcggcaacaucgucuccagcgugaacaugaucucccgcaugcugaucaaccgguucaccaugcgccacaagaaggccacguacgagcccgacguggaccucgggagcggcacccggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggucaacggcguggugcgccugcucaccaagccgugggacguccugcccaccgugacgcagauggcgaugaccgacaccacccccuucgggcagcagcggguguucaaggagaaggucgacacgcgcacccaggagcccaaggagggcaccaagaagcugaugaagaucaccgccgaguggcucuggaaggagcugggcaagaagaagacgccgcggaugugcacccgcgaggaguucacccggaaggugcgcuccaacgccgcccugggggccaucuucaccgacgagaacaaguggaaguccgcgcgggaggccguggaggacucccgcuucugggagcucgucgacaaggagcggaaccugcaccuggagggcaagugcgagacgugcguguacaacaugauggggaagcgcgagaagaagcucggcgaguucgggaaggccaagggcagccgggccaucugguacauguggcugggcgcccgcuuccuggaguucgaggcgcucggguuccugaacgaggaccacugguucucccgggagaacagccuguccggcgucgagggggagggccuccacaagcugggguacauccugcgcgacgugagcaagaaggagggcggcgccauguacgccgacgacaccgccgggugggacacccggaucacccucgaggaccugaagaacgaggagauggugacgaaccacauggagggcgagcacaagaagcuggcggaggccaucuucaagcucaccuaccagaacaaggucgugcgcgugcagcggcccacgccccgggggaccgucauggacaucaucagccggcgcgaccagcggggcuccggccaggugggcacguacggccugaacaccuucaccaacauggaggcccagcugauccgccagauggagggggagggcguguucaagaacauccagcaccucaccgucacggaggagguggccgugcagaacuggcuggcccgcgucgggcgggagcgccugagccggauggcgaucuccggcgacgacugcguggugaagccccucgacgaccgcuucgccaacgcccugaccgcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcccggaucagccagggcgcgggguggucccuccgcgagaccgccugccugggcaagagcuacgcccagauguggucccugauguacuuccaccggcgcgaccuccggcuggccgccaacgcgaucugcagcgccgugcccucccacugggugccgacgagccgcaccaccugguccauccacgccaagcacgaguggaugaccaccgaggacaugcugacggucuggaacaagguguggauccgggagaaccccuggauggaggacaagacccccguggagagcugggaggagauccccuaccucggcaagcgcgaggaccaguggugcgggucccugaucggccugaccagccgggccaccugggccaagaacauccaggcggccaucaaccagguccgcucccucaucgggaacgaggaguacacggacuacaugccgagcaugaagcgguuccgccgcgaggaggaggaggccggcgugcugugguga

SEQ ID NO: 9514 - RNA, 9876 nt, Artificial Sequence
  derived and/or modified CDS sequence (opt1) from DENV-2__FJ024452__SS-prME
agcgccggcaugaucaucaugcugauccccaccgugauggccuuccaccucaccacccggaacggggagccccacaugaucgugggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgggcaccgccgggagaagcgcagcgucgcccuggugccccacgugggcauggggcucgagacgcggaccgagaccuggauguccagcgagggcgccuggaagcacgcccagcgcaucgagaccuggauccugcggcacccgggguucacgaucauggccgcgauccuggccuacaccaucggcaccacccacuuccagcgcguccucaucuucauccugcugacggccguggcccccuccaugaccaugcggugcaucggcaucagcaaccgcgacuucguggagggggucuccggcgggagcuggguggacaucgugcucgagcacggcuccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucaucugcaagcacagcaugguggaccgcggguggggcaacgggugcggccucuucgggaagggcggcaucgugacgugcgccauguucacgugcaagaagaacauggaggggaagaucguccagcccgagaaccuggaguacaccaucguggugacgccccacuccggcgaggagcacgcggucgggaacgacacgggcaagcacgggaaggagaucaaggugaccccgcagagcuccaucaccgaggccgagcugaccggcuacggcaccgugacgauggagugcagcccccggaccgggcucgacuucaacgagaugguccugcugcagauggagaacaaggccuggcucgugcaccgccagugguuccuggaccugccccuccccuggcugccgggcgccgacaagcaggaguccaacuggauccagaaggagacccuggugaccuucaagaacccccacgccaagaagcaggacgucgugguccucgggagccaggagggcgcgaugcacacggcccugaccggggccaccgagauccagaugagcuccggcaaccugcuguucaccggccaccugaagugccggcugcgcauggacaagcuccagcugaaggggaugagcuacuccaugugcacgggcaaguucaagguggugaaggagaucgccgagacccagcacgggaccaucgucauccgggugcaguacgagggcgacggcagccccugcaagauccccuucgagaucauggaccuggagaagcgcuacgugcucgggcggcugaucaccgucaacccgaucgugacggagaaggacucccccgugaacaucgaggccgagccgcccuucggcgacagcuacaucaucaucggggucgagccgggccagcugaagcucaacugguucaagaagggguccagcaucggccagauguucgagaccaccaugcgcggcgcgaagcgcauggccauccugggggacaccgccugggacuucggcucccucggcgggguguucacgagcaucgggaaggcccuccaccagguguucggggccaucuacggcgcggccuucuccggggucagcuggaccaugaagauccugaucggcgugaucaucaccuggaucgggaugaacucccggagcaccucccugagcgugucccugguccucgugggcaucgugacgcuguaccugggggucauggugcaggccgacagcggcugcguggucuccuggaagaacaaggagcucaagugcggcagcgggaucuucaucaccgacaacgugcacaccuggaccgagcaguacaaguuccagcccgagagccccuccaagcuggccagcgcgauccagaaggcccaggaggagggcaucugcgggauccgcuccgugacgcggcuggagaaccucauguggaagcagaucacccccgagcugaaccacauccuggccgagaacgaggucaagcucaccaucaugaccggcgacaucaaggggaucaugcaggccggcaagcgcagccugcggccgcagcccacggagcugaaguacuccuggaagaccuggggcaaggccaagaugcucagcaccgaguccuacaaccagaccuuccugaucgacgggcccgagacggcggagugcccgaacaccaaccgcgccuggaacagccuggagguggaggacuacggcuucgggguguucaccaccaacaucuggcucaagcugaaggagaagcaggacgccuucugcgacuccaagcugaugagcgccgccaucaaggacaaccgggcgguccacgccgacaugggcuacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgccgggcccgucagccagcacaacuaccgcccgggcuaccacacccagaucgcggggcccuggcaccugggcaagcuggagauggacuucgacuucugcgacgggaccaccgugaucgugacggaggacugcggcaaccggggccccucccuccgcaccaccaccgccagcgggaagcugaucacggaguggugcugccggagcugcacccugcccccgcuccgcuaccggggcgaggacgggugcugguacggcauggagauccgcccccugaaggagaaggaggagaaccuggucaacucccucgugaccgccgggcacggccagguggacaacuucagccugggcguccuggggauggcccucuuccuggaggagaugcugcggacccgcgugggcacgaagcacgcgauccuccugguggccgucuccuucgugacccugaucaccgggaacaugagcuucaaggaccucggccggguggucgugauggugggggccaccauggccgacgacaucggcaugggcgucacguaccuggcccugcucgcggccuucaaggugcgccccaccuucgccgccgggcugcugcuccggaagcugaccuccaaggagcugaugaugaccacgaucggcaucgugcuccugagccaguccaccauccccgagaccguccuggagcucaccgacgcccuggcgcuggggaugauggugcucaagaucgugcgcaacauggagaaguaccagcuggccgucacgaucauggccauccugugcgugccgaacgccgucauccuccagaacgccuggaaggugagcugcaccauccuggcgguggucuccgugagcccccugcuccugaccuccagccagcagaagaccgacuggaucccccuggcccucacgaucaagggccugaaccccaccgccaucuuccugaccacccucucccgcacgaacaagaagcggagcuggccgcugaacgaggccaucauggcggugggcauggucuccauccuggccagcucccuccugaagaacgacauccccaugaccgggccccugguggccggcgggcuccugaccgugugcuacguccugaccggccgcagcgccgaccucgagcuggagcgggccacggacgugaagugggaggaccaggcggagaucuccgggagcagccccauccuguccaucaccaucagcgaggacggcuccaugagcaucaagaacgaggaggaggagcagacccucaccauccugauccgcacgggccugcucgugaucuccgggcuguucccgaucagcauccccaucaccgccgccgccugguaccugugggaggucaagaagcagcgggccggcgugcucugggacgugcccagcccgccgcccauggggaaggcggagcuggaggacggcgccuaccgcaucaagcagaaggggauccugggcuacagccagaucggcgccggggucuacaaggagggcaccuuccacaccauguggcacgugacccgcggggcggugcucaugcacaagggcaagcgcaucgagcccuccugggccgacgucaagaaggaccugaucagcuacgggggcggcuggaagcuggagggggaguggaaggagggcgaggagguccaggugcucgcgcuggagcccgggaagaacccccgggccguccagacgaagcccggccuguucaagaccaacaccgggaccaucggcgccgugucccucgacuucagccccggcacguccgggagccccaucaucgacaagaagggcaagguggucgggcuguacggcaacggcguggugacccgcuccggggccuacgucagcgccaucgcgcagaccggcaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcguggucgccgccgagauggaggaggcccugcggggccugcccauccgcuaccagacccccgccauccgggcggagcacacgggccgcgagaucguggaccucaugugccacgccaccuucaccaugcgccugcugagccccgugcgggucccgaacuacaaccucaucaucauggacgaggcccacuucaccgaccccgccuccaucgccgcgcgcggguacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggucugguucgugccgagcaucaaggcgggcaacgacaucgccgccugccugcggaagaacgggaagaaggugauccagcugucccgcaagaccuucgacagcgaguacgucaagacccggaucaacgacugggacuucguggugaccacggacaucuccgagaugggcgccaacuucaaggcggagcgcgucaucgacccccggcgcugcaugaagcccgugauccucaccgacggggaggagcgggugauccuggccggccccaugccggucacccacagcuccgccgcccagcgccgggggcgcaucggccggaaccccaagaacgagaacgaccaguacaucuacaugggcgagccccuggagaacgacgaggacugcgcccacuggaaggaggcgaagaugcuccuggacaacaucaacacccccgaggggaucaucccgagcauguucgagcccgagcgcgagaagguggacgccaucgacggcgaguaccggcugcgcggggaggcccgcaagacguucguggaccucaugcggcgcggcgaccugcccgucuggcuggccuacaagguggccgcggaggggaucaacuacgccgaccggcgcuggugcuucgacggcaucaagaacaaccagauccucgaggagaacguggaggucgagaucuggaccaaggagggcgagcggaagaagcugaagccgcgcuggcuggacgcccggaucuacuccgacccccucgcccugaaggaguucaaggaguucgccgcggggcgcaagagccugacccucaaccugaucaccgagaugggccggcugcccacguucaugacccagaagacccgcgacgcccucgacaaccuggccgugcugcacaccgccgaggccgggggccgggccuacaaccacgcccucuccgagcugcccgagacgcuggagacccuccugcugcucacccugcuggccaccgucacgggcgggaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucaccuacguggucaucgccauccugacggugguggccgcgaccauggccaacgagaugggcuuccuggagaagaccaagaaggaccucggccugggguccaucgccacccagcagccggagagcaacauccuggacaucgaccuccgccccgccuccgccuggacgcuguacgcggucgccaccaccuucgugacccccaugcugcggcacagcaucgagaacagcuccgugaacgucagccucacggccaucgccaaccaggccaccgugcugaugggccuggggaagggcuggccccucuccaagauggacaucggggugccgcugcuggcgaucggcugcuacagccaggucaaccccaucacccucaccgccgcccugcugcuccugguggcccacuacgcgaucaucggccccgggcugcaggccaaggccacgcgcgaggcccagaagcgggccgcggccggcaucaugaagaaccccaccguggacgggaucaccgucaucgaccucgacccgauccccuacgaccccaaguucgagaagcagcugggccaggugaugcugcucauccugugcgugacccagguccugaugaugcgcacgaccugggcccucugcgaggcccugacccuggccaccgggcccaucuccacgcucugggagggcaacccgggccgguucuggaacaccaccaucgcggugagcauggccaacaucuuccgcggguccuaccuggccggcgccgggcuccuguucagcaucaugaagaacaccacgaacacccggcgcggcaccggcaacaucggggagacccugggcgagaaguggaagucccgccugaacgcccucgggaaguccgaguuccagaucuacaagaaguccggcauccaggagguggaccggacgcuggcgaaggaggggaucaagcgcggcgagaccgaccaccacgccgucagccggggcuccgccaagcugcgcugguucguggagcggaacauggugacccccgaggggaaggucguggaccucggcugcgggcgcggcggguggagcuacuacugcggcggccugaagaacgugcgggaggucaaggggcugaccaagggcgggcccggccacgaggagcccaucccgauguccacguacggguggaaccucgugcgccugcagagcggcguggacgucuucuucaucccgcccgagaagugcgacacccugcucugcgacaucggcgaguccagccccaacccgaccguggaggccgggcggacccugcgcgugcugaaccucgucgagaacuggcugaacaacaacacgcaguucugcaucaaggugcugaaccccuacaugcccuccgugaucgagaagauggaggcgcugcagcggaaguacggcggggcccucguccgcaacccgcugagccggaacagcacccacgagauguacuggguguccaacgccagcggcaacaucguguccagcgucaacaugaucucccgcaugcugaucaaccgguucaccaugcgccacaagaaggccaccuacgagcccgacguggaccucgggagcggcacccggaacaucggcaucgaguccgagauccccaaccuggacaucaucgggaagcgcaucgagaagaucaagcaggagcacgagacgagcuggcacuacgaccaggaccaccccuacaagaccugggccuaccacggcuccuacgagaccaagcagaccgggagcgcguccagcauggugaacggcgucgugcggcugcucacgaagccgugggacgugcugcccaccgucacccagauggccaugaccgacacgacccccuucggccagcagcgcguguucaaggagaagguggacacccgcacccaggagcccaaggaggggacgaagaagcugaugaagaucaccgccgaguggcucuggaaggagcugggcaagaagaagaccccgcggaugugcacccgcgaggaguucacgcggaagguccgcuccaacgccgcccugggggcgaucuucaccgacgagaacaaguggaaguccgcccgggaggccguggaggacucccgcuucugggagcucaucgacaaggagcggaaccugcaccuggagggcaagugcgagaccugcguguacaacaugauggggaagcgcgagaagaagcucggcgaguucggcaaggccaaggggagccgggccaucugguacauguggcugggcgcgcgcuuccuggaguucgaggcccucggguuccugaacgaggaccacugguucucccgggagaacagccuguccggcgucgagggggagggccuccacaagcugggcuacauccugcgcgacgugagcaagaaggagggcggcgccauguacgccgacgacaccgcggggugggacacgcggaucacccucgaggaccugaagaacgaggagauggucaccaaccacauggagggcgagcacaagaagcuggccgaggccaucuucaagcucaccuaccagaacaagguggugcgcguccagcggcccacgccccgcgggaccgugauggacaucaucagccggcgcgaccagcggggcuccggccagguggggaccuacggccugaacaccuucacgaacauggaggcccagcugauccgccagauggagggggagggcgucuucaagaacauccagcaccucaccgugaccgaggagguggccguccagaacuggcuggcgcgggugggccgcgagcgccugagccggauggccaucuccggggacgacugcguggucaagccccucgacgaccgcuucgccaacgcccugaccgcccugaacgacaugggcaaggugcggaaggacauccagcagugggagccgagcaagggguggaacgacuggacccaggugcccuucugcucccaccacuuccacgagcucaucaugaaggacggccgcguccugguggugcccugccggaaccaggacgagcugaucgcgcgcgcccggaucagccagggggccggcuggucccuccgcgagaccgccugccugggcaagagcuacgcccagauguggucccugauguacuuccaccggcgcgaccuccggcuggcggccaacgccaucugcagcgccguccccucccacugggugccgaccagccgcaccacgugguccauccacgccaagcacgaguggaugaccaccgaggacaugcugaccguguggaaccgggucuggauccgcgagaaccccuggauggaggacaagacccccguggagagcugggaggagauccccuaccucgggaagcgggaggaccaguggugcggcucccugaucgggcugacgagccgcgcgaccugggccaagaacauccaggccgccaucaaccaggugcggucccucaucggcaacgaggaguacaccgacuacaugccgagcaugaagcgcuuccggcgcgaggaggaggaggcggggguccugugguga

SEQ ID NO: 9515 - RNA, 9876 nt, Artificial Sequence
  derived and/or modified CDS sequence (opt1) from DENV-2__FJ205877__SS-prME
agcgccgggaugaucaucaugcugauccccaccgugauggccuuccaccucaccacccgcaacggggagccgcacaugaucgucgggauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcgcagcgucgcccuggugccccacguggggaugggccucgagacccggaccgagaccuggaugagcagcgagggggccuggaagcacgcccagcgcaucgagaccuggauccugcggcaccccggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugcccgacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagcgccgguacguccucggccgccugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcggauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccgcagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgguccgucacgcgccuggagaaccucauguggaagcagaucacccccgagcugaaccacauccuggccgagaacgaggugaagcucaccaucaugaccggggacaucaagggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucaugaccauccugugcgucccgaacgccgugauccuccagaacgccuggaaggugagcugcaccauccuggccgucguguccgugagcccccugcuccugaccuccagccggcagaagacggacuggaucccccuggcgcucaccaucaaggggcugaaccccaccgccaucuuccugaccacgcucucccgcaccaacaagaagcggagcuggccgcugaacgaggccaucauggccgucggcaugguguccauccuggcgagcucccuccugaagaacgacauccccaugaccggcccccugguggccgggggccuccugaccgucugcuacgugcugacggggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacccucacgauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguacaaggaggggaccuuccacaccauguggcacgugacgcggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgcuccggcgccuacgugagcgccaucgcccagaccgagaaguccaucgaggacaaccccgagaucgaggacgacaucuuccggaagcgccggcugacgaucauggaccugcaccccggggcgggcaagaccaagcgcuaccuccccgccaucgugcgggaggccaucaagcgcgggcugcggacccugauccucgccccgacccgcgucguggcggccgagauggaggaggcccugcggggccugcccauccgcuaccagacgcccgccauccgcgccgagcacaccgggcgggagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggcgaggcggccgggaucuucaugaccgccacgccgcccggcagccgcgacccguucccccaguccaacgcccccaucaucgacgaggagcgggagauccccgagcgcagcuggaacuccgggcacgagugggucacggacuucaagggcaagaccgugugguucgugccgagcaucaaggccgggaacgacaucgcggccugccugcggaagaacggcaagaaggucauccagcugucccgcaagaccuucgacagcgaguacgugaagacccggacgaacgacugggacuucguggucaccaccgacaucuccgagaugggcgccaacuucaaggccgagcgcgugaucgacccccggcgcugcaugaagcccgugauccucaccgacggggaggagcgggucauccuggcgggccccaugccggugacgcacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgcgaucgacggcgaguaccgccugcgcggggaggcccgcaagaccuucgucgaccucaugcggcgcggcgaccugcccguguggcuggccuacaagguggccgccgaggggaucaacuacccggaccggcgcuggugcuucgacggcaucaagaacaaccagauccucgaggagaacgucgagguggagaucuggcccaaggagggggagcggaagaagcugaagccccgcuggcuggacccccggaucuacuccgagccgcgcgcgcucaaggaguucaaggaguucccgcccggccggaagucccugacccugaaccucaucacggagaugggccgccugcccaccuucaugacccagaagacccgggacgcccuggacaaccucgccgggcugcacacggccgaggccggcgggcgcgcggacaaccacgcccuguccgagcucgccgagacccuggagacccugcuccugcugacccuccuggccacgggcaccggcgggaucuuccuguuccucaugagcggccgggggaucggcaagaugacccuggggaugugcugcaucaucaccgcguccauccugcucugggacgcccagauccagccgcacuggaucgccgccagcaucauccuggaguucuuccugaucguccuccugauccccgagcccgagaagcagcgcacgccccaggacaaccagcugacguacguggugaucgccauccucaccgucgugggcgcgaccaugccgaacgagaugggcuuccuggagaagaccaagaaggaccuggggcucggcuccaucgccacgcagcagcccgagagcaacauccuggacaucgaccugcggcccgccuccgccuggacccucuacgccguggcgaccaccuucgucacgcccaugcugcgccacagcaucgagaacagcuccgugaacgugagccugaccgccaucgccaaccaggccaccguccucauggggcugggcaaggggugggcccuggcgaagauggacaucggcgugccgcuccugggcaucgggugcuacucccaggugaaccccaucacccugacgggcgcccuccugcugcucgggggccacuacgccaucaucgggcccggccugcaggccaaggccacccgggaggcgcagaagcgcgccgcccccggcaucaugaagaacccgaccgucgacgggaucaccgugaucgaccuggaccccauccccuacgaccccaaguucgagaagcagcucggccaggugaugcugcugauccucugcgucacccaggugcugaugaugcggaccaccugggcccugugcgaggcgcucacccuggccacggggccgaucagcacccugugggagggcaaccccggccgcuucuggaacaccaccaucgccguguccauggccaacaucuuccgcgggagcuaccucgccggcgcggggcugcuguucuccaucaugaagaacacgaccaacacccggcgcggcaccgggaacaugggcgagacgcucggcgagaaguggaagucccggcugaacgcccuggggaaguccgaguuccagaucuacaagaaguccggcauccaggaggucgaccgcacccucgccaaggaggggaucaagcggggcgagaccgaccaccacgccgugucccgcgggagcgccaagcugcggugguucguggagcgcaacauggucacccccgagggcaaggugguggaccugggcugcgcgcgcggcgggugguccuacuacugcgggggccucaagaacguccgcgaggugaaggggcugacgaagggcggccccgggcacgaggagccgauccccaugagcaccuacggcuggaaccuggugcggcuccaguccggggucgacguguucuucaucccgcccgagaagugcgacacccugcugugcgacaucggcgagagcucccccaaccccaccguggaggccgggcgcacgcuccggguccugaaccugguggagaacuggcucaacaacaacacccaguucugcaucaaggugcugaaccccuacaugcccagcgucaucgagaagauggaggcccugcagcgcaaguacggcggcgcccuggugcggaacccccucucccgcaacagcacccacgagauguacugggugagcaacgccuccgggaacaucgucagcuccgugaacaugaucagccggaugcugaucaaccgcuucaccaugcggcacaagaaggcgaccuacgagcccgacguggaccugggcuccgggacgcgcaacaucggcaucgagagcgagauccccaaccucgacaucaucggcaagcgcaucgagaagaucaagcaggagcacgagaccuccuggcacuacgaccaggaccacccguacaagaccugggccuaccacgggagcuacgagaccaagcagacgggcuccgccagcuccauggucaacgggguggugcggcugcugaccaagcccugggacguccuccccaccgugacccagauggccaugacggacaccacccccuucggccagcagcgcguguucaaggagaaggucgacacccggacgcaggacccgaaggaggggaccaagaagcugaugaagaucaccgcggaguggcuguggaaggagcucggcaagaagaagacgccccggaugugcacgcgggaggaguucacccgcaaggugcggagcaacgccgcccugggcgccaucuucaccgacgagaacaaguggaaguccgcccgcgaggcgguggaggacagccgguucugggagcuggucgacaaggagcgcaaccuccaccuggaggggaagugcgagaccugcguguacaacaugaugggcaagcgggagaagaagcugggggaguucggcaaggccaaggccucccgcgccaucugguacauguggcucggggcccgguuccuggaguucgaggcgcugggcuuccucaacgaggaccacugguucagccgcgagaacucccugagcggcguggagggggagggccugcacaagcucggguacauccugcgggacgucuccaagaaggagggcggggccauguacgccgacgacacggccggcugggacacccgcaucacccuggaggaccucaagaacgaggagauggugaccaaccacauggagggcgagcacaagaagcuggccgaggcgaucuucaagcugacguaccagaacaaggucgugcgggugcagcgccccacgccccgggggaccgucauggacaucaucagccgccgggaccagcgcggcagcggccagguggccaccuacggccucaacacguucaccaacauggaggcccagcugauccgccagauggagggcgaggggguguucaagaacauccagcaccugaccgucaccgaggagguggccgugcagaacuggcucgcgcgggucggccgcgagcggcugccgcgcauggccaucuccggggacgacugcguggugaagccccuggacgcccgguucgccaacgcccucacggcgcugaacgccaugggcaagauccgcaaggacauccagcagugggagcccagcaagggguggaacgacuggacccagguccccuucugcucccaccacuuccacgagcugaucaugaaggacggccgggugcucguggucccgugccgcaaccaggacgagcugaucggccgggcccgcaucagccagggggccggcuggucccugcgggagaccgccugccucggcaagagcuacgcgcagauguggucccugauguacuuccaccgccgggaccugcgccucgccgccaacgccaucugcagcgccgugcccucccacugggugcccaccagccggacgaccugguccauccacgcgaagcacgaguggaugaccaccgaggacaugcugaccgucuggaacaagguguggauccgcgagaaccccuggauggaggacaagacgccgguggagagcugggaggagauccccuaccugggcaagcgggaggaccaguggugcgggucccucaucggccugaccagccgcgccaccugggccaagaacauccaggccgccaucaaccagguccggucccugaucggcaacgaggaguacaccgacuacaugcccagcaugaagcgcuuccgccgggaggaggaggaggcgggggugcucugguga

SEQ ID NO: 9516 - RNA, 9876 nt, Artificial Sequence
  derived and/or modified CDS sequence (opt1) from DENV-2__FJ024454__SS-prME
agcgcggggaugaucaucaugcugauccccaccgugauggccuuccaccucaccacccggaacggggagccgcacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugcccgacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggccccgucaccauggagugcagcccccggacgggccucgacuucaacgagauggugcugcugcagauggagaacaaggccuggcucgugcaccgccagugguuccuggaccugccccucccguggcugcccggggccgacaagcaggaguccaacuggauccagaaggagacccuggucaccuucaagaacccccacgccaagaagcaggacguggucgugcucggcagccaggagggggcgaugcacaccgcccugacgggcgccaccgagauccagaugagcuccgggaaccuccuguucaccggccaccugaagugccggcugcgcauggacaagcuccagcugaagggcaugagcuacuccaugugcaccgggaaguucaagguggucaaggagaucgccgagacgcagcacggcaccaucgugauccgggugcaguacgagggggacggcagccccugcaagaucccguucgagaucauggaccuggagaagcgcuacguccucggccggcugaucaccgugaaccccaucgugaccgagaaggacucccccgucaacaucgaggccgagcccccguucggggacagcuacaucaucaucggcguggagcccgggcagcugaagcucaacugguucaagaagggcuccagcaucgggcagauguucgagacgaccaugcgcggcgcgaagcgcauggccauccugggcgacaccgccugggacuucgggucccugggcgggguguucaccagcaucggcaaggcccuccaccaggucuucggggccaucuacggcgcggccuucuccggcgugagcuggacgaugaagauccugaucggggugaucaucaccuggaucggcaugaacucccggagcaccucccugagcgucucccuggugcucguggggaucgucacccuguaccugggcgugauggugcaggccgacagcgggugcgucguguccuggaagaacaaggagcucaagugcggcagcggcaucuucaucacggacaacgugcacaccuggaccgagcaguacaaguuccagcccgagagccccuccaagcuggccagcgcgauccagaaggcccaggaggaggggaucugcggcauccgcuccgucacccggcuggagaaccucauguggaagcagaucacgccggagcugaaccacauccuggccgagaacgaggugaagcucaccaucaugaccggggacaucaagggcaucaugcaggccgggaagcgcagccugcggccccagcccaccgagcugaaguacuccuggaagacguggggcaaggccaagaugcucagcaccgaguccuacaaccagaccuuccugaucgacggcccggagaccgcggagugccccaacacgaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacaccuggaagaucgagaaggccagcuucaucgaggugaagaacugccacuggcccaagucccacacgcuguggagcaacggcguccuggaguccgagaugaucauccccaagaaccucgccggcccggugagccagcacaacuaccgccccggguaccacacccagaucgcgggccccuggcaccuggggaagcuggagauggacuucgacuucugcgacggcaccaccgugaucgucaccgaggacugcgggaaccggggccccucccuccgcacgaccaccgccagcggcaagcugaucaccgaguggugcugccggagcugcacgcugccgccccuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggaccaagcacgcgauccuccuggucgccguguccuucgugacgcugaucaccggcaacaugagcuucaaggaccucgggcgggucguggugauggucggcgccaccauggccgacgacaucgggaugggcgugaccuaccuggcccugcucgcggccuucaaggugcgccccacguucgccgccggccugcugcuccggaagcugaccuccaaggagcugaugaugaccaccaucgggaucguccuccugagccaguccacgaucccggagaccgugcuggagcucaccgacgcccuggcgcugggcaugauggugcucaagaucguccgcaacauggagaaguaccagcuggccgugaccaucauggccauccugugcguccccaacgccgugauccuccagaacgccuggaaggugagcugcacgauccuggcggucguguccgugagcccccugcuccugaccuccagccagcagaagaccgacuggaucccccuggcccucaccaucaaggggcugaacccgacggccaucuuccugaccacccucucccgcaccaacaagaagcggagcuggccccugaacgaggccaucauggcggucggcaugguguccauccuggccagcucccuccugaagaacgacauccccaugacgggcccccugguggccgggggccuccugaccgucugcuacgugcugaccgggcgcagcgccgaccucgagcuggagcgggccaccgacgugaagugggaggaccaggcggagaucuccggcagcagcccgauccuguccaucacgaucagcgaggacggguccaugagcaucaagaacgaggaggaggagcagacccucaccauccugauccgcaccggccugcucgucaucuccggccuguuccccaucagcauccccaucacggccgccgccugguaccugugggaggugaagaagcagcgggccggggugcucugggacguccccuccccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagccguccugggccgacgugaagaaggaccugaucagcuacggcgggggcuggaagcuggagggcgaguggaaggagggggaggaggugcagguccucgcgcuggagcccggcaagaacccccgggccgugcagaccaagcccgggcuguucaagacgaacaccggcaccaucggggccgugucccucgacuucagcccgggcaccuccggcagccccaucaucgacaagaaggggaaggucgugggccuguacgggaacggcguggucacgcgcuccggcgccuacgugagcgccaucgcgcagaccgagaaguccaucgagaacaaccccgagaucgaggacgacaucuuccggaagcgccggcugaccaucauggaccugcaccccggggccggcaagaccaagcgcuaccucccggccaucgugcgggaggccaucaagcgcgggcugcggacgcugauccucgcgcccacccgcgucguggccgccgagauggaggaggcccugcggggccugcccauccgcuaccagacccccgccauccgggcggagcacaccgggcgcgagaucguggaccucaugugccacgccacguucaccaugcgccugcugagcccgguccgggugcccaacuacaaccucaucaucauggacgaggcccacuucaccgaccccgccuccaucgccgcgcgcggcuacaucagcacccggguggagaugggcgaggccgccgggaucuucaugacggccacgccgcccggcagccgcgaccccuucccccaguccaacgcccccaucaucgacgaggagcgggagauccccgagcgcagcuggaacuccgggcacgagugggucaccgacuucaagggcaagaccgugugguucgugcccagcaucaaggcggggaacgacaucgccgccugccugcggaagaacggcaagaaggucauccagcugucccgcaagacguucgacagcgaguacgugaagacccggaccaacgacugggacuucguggucaccacggacaucuccgagaugggcgccaacuucaaggcggagcgcgugaucgacccccggcgcugcaugaagcccgugauccucaccgacggggaggagcgggucauccuggccggcccgaugcccgugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacaccccggagggcaucauccccagcauguucgagcccgagcgcgagaagguggacgccaucgacggcgaguaccggcugcgcggggaggcccgcaagacguucgucgaccucaugcggcgcggcgaccugccgguguggcuggccuacaagguggccgcggaggggaucaacuacgccgaccggcgcuggugcuucgacggcaucaagaacaaccagauccucgaggagaacgucgagguggagaucuggcccaaggagggggagcggaagaagcugaagccccgcuggcuggacgcccggaucuacuccgacccccucgcccugaaggaguucaaggaguucgccgcgggccgcaagagccugacccucaaccugaucaccgagaugggccggcugccgaccuucaugacgcagaagacccgcgacgcccucgacaaccuggccguccugcacaccgccgaggccggcgggcgggccuacaaccacgcccucuccgagcugcccgagacccuggagacgcuccugcugcucacccugcuggccaccgugaccgggggcaucuuccucuuccugaugagcggccgcgggaucggcaagaugacgcuggggaugugcugcaucaucaccgccuccauccuccugugguacgcgcagauccagccccacuggaucgccgccagcaucauccuggaguucuuccucaucgugcugcugauccccgagccggagaagcagcggacgccccaggacaaccagcucaccuacgucgugaucgccauccugaccguggucgccgcgacgauggccaacgagaugggcuuccuggagaagaccaagaaggaccucgggcugggcuccaucgccacccagcagcccgagagcaacauccuggacaucgaccuccgccccgccuccgccuggacccuguacgcgguggccacgaccuucgugaccccgaugcugcggcacagcaucgagaacagcuccgucaacgugagccucaccgccaucgccaaccaggccacggugcugaugggccuggggaagggcuggccccucuccaagauggacaucggggucccccugcuggcgaucggcugcuacagccaggugaaccccaucacccucaccgccgcccugcugcuccugguggcccacuacgcgaucaucgggccgggccugcaggccaaggccacccgcgaggcccagaagcgggccgcggccggcaucaugaagaaccccacggucgacgggaucaccgugaucgaccucgaccccauccccuacgacccgaaguucgagaagcagcugggccaggugaugcugcucauccugugcgucacccaggugcugaugaugcgcaccacgugggcccucugcgaggcccugacccuggccaccgggcccaucuccacccucugggagggcaaccccgggcgguucuggaacacgaccaucgcggugagcauggccaacaucuuccgcggcuccuaccuggccggcgccgggcuccucuucagcaucaugaagaacaccaccaacacgcggcgcggcaccgggaacaugggcgagacccugggcgagaaguggaagucccgccugaacgcccucggcaagagcgaguuccagaucuacaagaaguccggcauccaggaggucgaccggacccuggcgaaggaggggaucaagcgcggcgagacggaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugaccaagggcgggccgggccacgaggagcccauccccauguccaccuacggguggaaccucgugcgccugcagagcggcgucgacguguucuucaucccgcccgagaagugcgacacgcugcucugcgacaucggggaguccagccccaaccccaccguggaggccggccggacccugcgcguccugaaccucguggagaacuggcugaacaacaacacccaguucugcaucaaggugcugaacccguacaugcccuccgucaucgagaagauggaggcgcugcagcggaaguacggcggggcccucgugcgcaacccccugagccggaacagcacgcacgagauguacuggguguccaacgccagcggcaacaucgucuccagcgugaacaugaucucccgcaugcugaucaaccgguucaccaugcgccacaagaaggccaccuacgagcccgacguggaccucgggagcggcacccggaacaucgggaucgaguccgagaccccgaaccuggacaucaucggcaagcgcaucgagaagaucaagcaggagcacgagacgagcuggcacuacgaccaggaccaccccuacaagaccugggccuaccacggcuccuacgagaccaagcagaccgggagcgcguccagcauggucacgggcguggugcggcugcucaccaagcccugggacguccugcccaccgugacccagauggccaugacggacaccaccccguucgggcagcagcgcguguucaaggagaaggucgacacccgcacgcaggaccccaaggaggccaccaagaagcugaugaagaucaccgccgaguggcucuggaaggagcugggcaagaagaagacgccccggaugugcacgcgcgaggaguucacccggaaggugcgcuccaacgccgcgcugggcgccaucuucaccgacgagaacaaguggaaguccgcccgggaggccguggaggacucccgcuucugggagcucgucgacaaggagcggaaccugcaccuggaggggaagugcgagaccugcguguacaacaugaugggcaagcgcgagaagaagcucggggaguucggcaaggccaaggggagccgggcgaucugguacauguggcugggcgcccgcuuccuggaguucgaggcccucggcuuccugaacgaggaccacugguucucccgggagaacagccuguccggggucgagggcgaggggcuccacaagcugggcuacauccugcgcgacgugagcaagaaggagggcggggccauguacgcggacgacacggccggcugggacacccggaucacccucgaggaccugaagaacgaggagauggugaccaaccacauggagggggagcacaagaagcuggccgaggccaucuucaagcucacguaccagaacaaggucgugcgcgugcagcggcccaccccgcgcggcaccgucauggacaucaucagccggcgcgaccagcggggguccggccagguggggaccuacggccugaacacguucaccaacauggaggcccagcugauccgccagauggagggcgaggggguguucaagaacauccagcaccuccccgucaccgaggagguggcggugcagaacuggcuggcccgggucggccgcgagcgccugagccggaugcccaucuccggggacgacugcguggugaagccccucgacgcccgcuucccgaccgcccugacgccccugaacgacaugggcaagauccggaaggacauccaccagugggaccccagcaagggcuggaacgacuggacccagguccccuucugcucccaccacuuccacgagcucaucaugaaggacgggcgcgugcugguggucccgugccggaaccaggacgaccugaucgcccgcgcgcggaucagccagggccccggguggucccuccgcgagaccgccugccugggcaagagcuacgcccagauguggucccugauguacuuccaccggcgcgaccuccggcuggccgccaacgcgaucugcagcgccgugcccucccacugggugcccaccagccgcacgaccugguccauccacgccaagcacgaguggaugaccaccgaggacaugcugaccgucuggaaccggguguggauccgcgagaacccguggauggaggacaagacgcccguggagagcugggaggagauccccuaccucgggaagcgggaggaccaguggugcggcucccugaucggccugaccagccgcgccaccugggccaagaacauccaggucgcgaucaaccaggugcggucccucaucgggaacgaggaguacaccgacuacaugccgagcaugaagcgcuuccggcgcgaggaggaggaggccggcgugcugugguga

SEQ ID NO: 9517 - RNA, 9876 nt, Artificial Sequence
  derived and/or modified CDS sequence (opt1) from DENV-2__FJ205878__SS-prME
agcgccgggaugaucaucaugcugauccccaccgucaccgccuuccaccucaccacccggaacggggagccccacaugaucgucggcauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccacgggcgagcaccgccgggagaagcgcagcgucgcccuggugccccacguggggaugggccucgagacccggaccgagaccuggauguccagcgagggggccuggaagcacgcccagcgcaucgagacguggauccugcggcacccgggcuucaccaucauggccgcgauccuggccuacaccaucgggaccacgcacuuccagcgcguccucaucuucauccugcugaccgccguggcccccuccaugaccaugcggugcaucggcaucagcaaccgcgacuucguggagggcgucuccgggggcagcuggguggacaucgugcucgagcacggguccugcgucaccacgauggcgaagaacaagcccacccuggacuucgagcugaucaagaccgaggccaagcagcccgccacccuccggaaguacugcaucgaggccaagcugacgaacaccaccaccgagagccgcugccccacgcagggcgagcccucccugaaggaggagcaggacaagcgguucgugugcaagcacagcaugguggaccgcggcugggggaacggcugcggccuguucggcaagggcgggaucgugaccugcgccauguucacgugcaagaagaacauggagggcaagaucgugcagcccgagaaccuggaguacaccaucguggucacgccccacuccggggaggagcacgcggugggcaacgacaccgggaagcacggccaggagaucaaggugaccccgcagagcuccaucaccgaggccgagcugaccggguacggcacggucaccauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucacguucaagaacccccacgccaagaagcaggacguggucgugcucggcagccaggagggggcgaugcacaccgcccugaccggcgccaccgagauccagaugagcuccgggaaccuccuguucacgggccaccugaagugccggcugcgcauggacaagcuccagcugaagggcaugagcuacuccaugugcaccgggaaguucaagguggucaaggagaucgccgagacccagcacggcaccaucgugauccgggugcaguacgagggggacggcagccccugcaagauccccuucgagaucauggaccuggagaagcgcuacguccucggccggcugaucacggugaacccgaucgugaccgagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacacggccugggacuucgggucccugggcgggguguucaccagcaucggcaaggcccuccaccaggucuucggggccaucuacggcgcggccuucuccggcgugagcuggaccaugaagauccugaucggggugaucaucaccuggaucggcaugaacucccggagcacgucccugagcgucucccuggugcucguggggaucgucacccuguaccugggcgugauggugcaggccgacagcgggugcgucguguccuggaagaacaaggagcucaagugcggcagcggcaucuucaucaccgacaacgugcacaccuggacggagcaguacaaguuccagcccgagagccccuccaagcuggccagcgcgauccagaaggcccaggaggaggggaucugcggcauccgcuccgucacccggcuggagaaccucauguggaagcagaucacccccgagcugaaccacauccuggccgagaacgaggugaagcucaccaucaugacgggggacaucaagggcaucaugcaggccgggaagcgcagccugcggccgcagcccaccgagcugaaguacuccuggaagaccuggggcaaggccaagaugcucagcaccgaguccuacaaccagacguuccugaucgacggccccgagaccgcggagugcccgaacaccaaccgcgccuggaacagccuggagguggaggacuacggguucggcgucuucaccacgaacaucuggcucaagcugaaggagaagcaggacgccuucugcgacuccaagcugaugagcgccgccaucaaggacaaccgggcggugcacgccgacaugggguacuggaucgaguccgcccucaacgacaccuggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccacggugaucgucaccgaggacugcgggaaccggggccccucccuccgcaccaccacggccagcggcaagcugaucaccgaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacgcgcguggggaccaagcacgcgauccuccuggucgccguguccuucgugacccugaucaccggcaacaugagcuucaaggaccucgggcgggucguggugauggucggcgccacgaugaccgacgacaucgggaugggcgugaccuaccuggcccugcucgccgcguucaaggugcgccccaccuucgccgccggccugcugcuccggaagcugacguccaaggagcugaugaugaccaccaucgggaucguccuccugagccaguccaccauccccgagacggugcuggagcucaccgacgcccuggcccugggcaugauggugcucaagaucguccgcaacauggagaaguaccagcuggcggugaccaucauggccauccugugcgucccgaacgccgugauccuccagaacgccuggaaggugagcugcaccauccuggccgucguguccgugagcccccugcuccugacguccagccagcagaagaccgacuggaucccccuggcgcucaccaucaaggggcugaaccccaccgccaucuuccugacgacccucucccgcaccaacaagaagcggagcuggccgcugaacgaggccaucauggccgucggcaugguguccauccuggcgagcucccuccugaagaacgacauccccaugaccggcccccugguggccgggggccuccugacggucugcuacgugcugaccgggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacgcucaccauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguaccgggaggggaccuuccacacgauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcccuggagcccggcaagaacccccgcgcggugcagaccaagcccgggcuguucaagaccaacacgggcaccaucggggccgugucccucgacuucagccccggcaccuccggcagccccaucaucgacaagaaggggaaggucgugggccuguacgggaacggcguggucacccgguccggcgccuacgugagcgccaucgcccagacggagaaguccaucgaggacaaccccgagaucgaggacgacaucuuccgcaagcggcgccugaccaucauggaccugcaccccggggcgggcaagaccaagcgguaccuccccgccaucgugcgcgaggccaucaagcgggggcugcgcacccugauccucgccccgacgcgggucguggcggccgagauggaggaggcccugcgcggccugcccauccgguaccagacccccgccauccgcgccgagcacaccgggcgcgagaucguggaccucaugugccacgcgaccuucacgaugcggcugcugagccccguccgcgugccgaacuacaaccucaucaucauggacgaggcccacuucaccgaccccgccuccaucgccgcccggggcuacaucagcacccgcguggagaugggcgaggcggccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagaccgugugguucgugccgagcaucaaggccgggaacgacaucgcggccugccugcgcaagaacggcaagaaggucauccagcugucccggaagaccuucgacagcgaguacgugaagacgcgcaccaacgacugggacuucguggucaccaccgacaucuccgagaugggcgccaacuucaaggccgagcgggugaucgacccccgccggugcaugaagcccgugauccucacggacggggaggagcgcgucauccuggcgggccccaugccggugacccacagcuccgccgcccagcggcgcgggcggaucggccgcaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgggagaagguggacgcgaucgacggcgaguaccgccugcgcggggaggcccggaagaccuucgucgaccucaugcgccggggcgaccugcccguguggcuggccuacaagguggccgccgaggggaucaacuacgcggaccgccgguggugcuucgacggcaucaagaacaaccagauccucgaggagaacgucgagguggagaucuggacgaaggagggggagcgcaagaagcugaagccgcgguggcuggacgcccgcaucuacuccgacccccucgcccugaaggaguucaaggaguucgccgccggccggaagucccugacccucaaccugaucaccgagaugggccgccugcccaccuucaugacgcagaagacccgggacgcgcucgacaaccuggccguccugcacaccgccgaggccgggggccgcgcguacaaccacgcccucuccgagcugcccgagacccuggagacgcuccugcugcucacccugcuggccaccgugaccgggggcaucuuccucuuccugaugagcggccgggggaucggcaagaugacccuggggaugugcugcaucaucacggccuccauccuccugugguacgcccagauccagccgcacuggaucgcggccagcaucauccuggaguucuuccucaucgugcugcugauccccgagcccgagaagcagcgcacgccccaggacaaccagcucaccuacgucgugaucgccauccugaccguggucgccgccacgauggcgaacgagaugggcuuccuggagaagaccaagaaggaccucgggcugggcuccaucgccacccagcagccggagagcaacauccuggacaucgaccuccggcccgccuccgccuggacccuguacgccguggcgacgaccuucgugacccccaugcugcgccacagcaucgagaacagcuccgucaacgugagccucaccgccaucgccaaccaggccacggugcugaugggccuggggaagggcuggccccucuccaagauggacaucggggucccgcugcuggccaucggcugcuacagccaggugaaccccaucacccucaccgcggcccugcugcuccugguggcccacuacgccaucaucgggcccggccugcaggcgaaggccacccgggaggcccagaagcgcgccgccgcgggcaucaugaagaaccccacggucgacgggaucaccgugaucgaccucgacccgauccccuacgaccccaaguucgagaagcagcugggccaggugaugcugcucauccugugcgucacccaggugcugaugaugcggaccacgugggcccucugcgaggcccugacccuggccaccgggcccaucuccacccucugggagggcaacccggggcgcuucuggaacacgaccaucgccgugagcauggcgaacaucuuccggggcuccuaccuggccggcgccgggcuccucuucagcaucaugaagaacaccaccaacacgcgccgcggcaccgggaacaugggcgagacccugggcgagaaguggaagucccggcugaacgcccucggcaagagcgaguuccagaucuacaagaaguccggcauccaggaggucgaccgcacccuggccaaggaggggaucaagcggggcgagacggaccaccacgcggugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggcccggccacgaggagcccaucccgauguccaccuacggguggaaccucgugcggcugcagagcggcgucgacguguucuucaucccgcccgagaagugcgacacgcugcucugcgacaucggggaguccagccccaacccgaccguggaggccggccgcacccugcggguccugaaccucguggagaacuggcugaacaacaacacccaguucugcaucaaggugcugaaccccuacaugcccuccgucaucgagaagauggaggcccugcagcgcaaguacggcggggcgcucgugcggaacccgcugagccgcaacagcacccacgagauguacuggguguccaacgccagcggcaacaucgucuccagcgugaacaugaucucccggaugcugaucaaccgcuucacgaugcggcacaagaaggccaccuacgagcccgacguggaccucgggagcggcacccgcaacaucgggaccgaguccgagauccccaaccuggacaucaucggcaagcggaucgagaagaucaagcaggagcacgagacgagcuggcacuacgaccaggaccaccccuacaagaccugggccuaccacggcuccuacgagaccaagcagaccgggagcgccuccagcauggucaacggcguggugcgccugcucacgaagccgugggacguccugcccauggugacccagauggcgaugaccgacaccacgcccuucgggcagcagcgcguguucaaggagaaggucgacacccggacccaggagcccaaggagggcaccaagaagcugaugaagaucacggccgaguggcucuggaaggagcugggcaagaagaagaccccgcgcaugugcacccgggaggaguucacccgcaaggugcgguccaacgccgcccugggggccaucuucacggacgagaacaaguggaaguccgcgcgcgaggccguggaggacucccgguucugggagcucgucgacaaggagcgcaaccugcaccuggagggcaagugcgagaccugcguguacaacaugauggggaagcgggagaagaagcucggcgaguucgggaaggccaagggcagccgcgccaucugguacauguggcugggcgcccgguuccuggaguucgaggcgcucggguuccugaacgaggaccacugguucucccgcgagaacagccuguccggcgucgagggggagggccuccacaagcugggguacauccugcgggacgugagcaagaaggagggcggcgccauguacgccgacgacaccgccgggugggacacccgcaucacgcucgaggaccugaagaacgaggagauggugaccaaccacauggagggcgagcacaagaagcuggcggaggccaucuucaagcucaccuaccagaacaaggucgugcgggugcagcgccccacgccccgggggacggucauggacaucaucagccgccgggaccagcgcggcuccggccagguggggaccuacggccugaacaccuucaccaacauggaggcccagcugauccggcagauggagggggagggcguguucaagaacauccagcaccucacggucaccgaggagguggccgugaagaacuggcuggcccgcgucgggcgcgagcggcugagccgcauggcgaucuccggcgacgacugcguggugaagccccucgacgaccgguucgccaacgcccugaccgcccugaacgacaugggcaagauccgcaaggacauccagcagugggagccgagcaagggguggaacgacuggacccagguccccuucugcucccaccacuuccacgagcucaucaugaaggacggccgggugcuggugguccccugccgcaaccaggacgagcugaucgggcgggcccgcaucagccagggcgcgggguggucccuccgggagacggccugccugggcaagagcuacgcccagauguggucccugauguacuuccaccgccgggaccuccgccuggccgccaacgcgaucugcagcgccgugcccucccacugggugccgaccagccggaccaccugguccauccacgccaagcacgaguggaugaccacggaggacaugcugaccgucuggaaccgcguguggauccgggagaaccccuggauggaggacaagacccccguggagagcugggaggagauccccuaccucggcaagcgcgaggaccaguggugcgggucccugaucggccugaccagccgggccacgugggccaagaacauccaggcggccaucaaccagguccgcucccucaucgggaacgaggaguacaccgacuacaugccgagcaugaagcgguuccgccgcgaggaggaggaggccggcgugcugugguga

SEQ ID NO: 9518 - RNA, 9876 nt, Artificial Sequence
  derived and/or modified CDS sequence (opt1) from DENV-2__FJ205879__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucaucugcaagcacagcaugguggaccgcggcugggggaacggcugcggccuguucggcaagggcgggaucgugacgugcgccauguucacgugcaagaagaacauggagggcaagaucguccagcccgagaaccuggaguacaccaucguggugacgccccacuccggggaggagcacgcggucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggagaacaaggccuggcucgugcaccgccagugguuccuggaccugccccuccccuggcugccgggggccgacaagcaggaguccaacuggauccagaaggagacccuggugaccuucaagaacccccacgccaagaagcaggacgucgugguccucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggugaaggagaucgccgagacccagcacggcaccaucgucauccgggugcaguacgagggggacggcagccccugcaagauccccuucgagaucauggaccuggagaagcgcuacgugcucggccggcugaucaccgucaacccgaucgugacggagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccagguguucggggccaucuacggcgcggccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcguguucaccaccaacaucuggcucaagcugaaggagaagcaggacgccuucugcgacuccaagcugaugagcgccgccaucaaggacaaccgggcgguccacgccgacaugggguacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgccggccccgucagccagcacaacuaccgcccgggguaccacacccagaucgcgggccccuggcaccuggggaagcuggagauggacuucgacuucugcgacggcaccaccgugguggucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaccaccgccuccauccuccugugguacgcgcagauccagccgcacuggaucgccgccagcaucauccuggaguucuuccucaucgugcugcugauccccgagcccgagaagcagcggacgccccaggacaaccagcucaccuacgucgugaucgccauccugaccguggucgccgcgaccauggccaacgagaugggcuuccuggagaagacgaagaaggaccucgggcugggcuccaucgccacccagcagccggagagcaacauccuggacaucgaccuccgccccgccuccgccuggacccuguacgcgguggccaccacguucgugacccccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacgcucaccgccgcccugcugcuccugguggcccacuacgcgaucaucgggcccggccugcaggccaaggccacccgcgaggcccagaagcgggccgcggccggcaucaugaagaaccccaccgucgacgggaucacggugaucgaccucgacccgauccccuacgaccccaaguucgagaagcagcugggccaggugaugcugcucauccugugcgucacccaggugcugaugaugcgcaccaccugggcccucugcgaggcccugacgcuggccaccgggcccaucuccacccucugggagggcaacccggggcgguucuggaacaccacgaucgcggugagcauggccaacaucuuccgcggcuccuaccuggccggcgccgggcuccucuucagcaucaugaagaacaccaccaacccccggcgcggcaccgggaacaugggcgagacgcugggcgagaaguggaagucccgccugaacgcccucgggaaguccgaguuccagaucuacaagcgguccggcauccaggaggucgaccgcacccuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugacgaagggcgggcccggccacgaggagccgauccccauguccaccuacggguggaaccucgugcggcugcagagcggcgucgacguguucuucaucccgcccgagaagugcgacacccugcucugcgacaucggggaguccagcccgaaccccaccguggaggccggccgcacgcugcggguccugaaccucguggagaacuggcugaacaacaacacccaguucugcaucaaggugcugaaccccuacaugccguccgucaucgagaagauggaggcgcugcagcgcaaguacggcggggcccucgugcggaacccccugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacgcgcaacaucgggaucgaguccgagauccccaaccuggacaucaucggcaagcggaucgagaagaucaagcaggagcacgagaccagcuggcacuacgaccaggaccacccguacaagaccugggccuaccacggcuccuacgagaccaagcagacggggagcgcguccagcauggucaacggcguggugcgccugcucaccaagcccugggacguccugcccaccgugacccagauggccaugacggacaccacccccuucgggcagcagcgcguguucaaggagaaggucgacacccggacgcaggagccgaaggagggcaccaagaagcugaugaagaucaccgccgaguggcucuggaaggagcugggcaagaagaagacgccccggaugugcacgcgggaggaguucacccgcaaggugcgguccaacgccgcccugggggcgaucuucaccgacgagaacaaguggaaguccgcccgcgaggccguggaggacucccgguucugggagcucgucgacaaggagcgcaaccugcaccuggagggcaagugcgagaccugcguguacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcgucgagggggagggccuccacaagcugggguacauccugcgggacgugagcaagaaggagggcggcgccauguacgccgacgacacggcggggugggacacccgcaucacccucgaggaccugaagaacgaggagauggugaccaaccacauggagggcgagcacaagaagcuggccgaggccaucuucaagcucacguaccagaacaaggucgugcgggugcagcgccccacgccccgggggaccgucauggacaucaucagccgccgggaccagcgcggcuccggccagguggggaccuacggccugaacacguucaccaacauggaggcccagcugauccggcagauggagggggagggcguguucaagaacauccagcaccucaccgucaccgaggagguggccgugcagaacuggcuggcgcgcgucgggcgcgagcggcugagccgcauggccaucuccggcgacgacugcguggugaagccgcucgacgaccgguucgccaacgcccugacggcccugaacgacaugggcaagauccgcaaggacauccagcagugggagcccagcaagggguggaacgacuggacccagguccccuucugcucccaccacuuccacgagcucaucaugaaggacggccgggugcuggugguccccugccgcaaccaggacgagcugaucgggcgggcgcgcaucagccagggcgccggguggucccuccgggagaccgccugccugggcaagagcuacgcccagauguggucccugauguacuuccaccgccgggaccuccgccuggccgcgaacgccaucugcagcgccgugccgucccacugggugcccaccagccggacgaccugguccauccacgccaagcacgaguggaugaccaccgaggacaugcugaccgucuggaaccgcguguggauccgggagaaccccuggauggaggacaagacgcccguggagagcugggaggagaucccguaccucggcaagcgcgaggaccaguggugcgggucccugaucggccugaccagccgggccaccugggcgaagaacauccaggccgccaucaaccagguccgcucccucaucgggaacgaggaguacaccgacuacaugcccagcaugaagcgguuccgccgcgaggaggaggaggccggcgugcugugguga

SEQ ID NO: 9519 - RNA, 9876 nt, Artificial Sequence
  derived and/or modified CDS sequence (opt1) from DENV-2__FJ390385__SS-prME
agcgccgggaugaucaucaugcugauccccaccgugauggccuuccaccucaccacccggaacggggagccccacaugaucguggggauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcggagcgucgcccuggugccccacguggggaugggccucgagacccggaccgagaccuggaugagcagcgagggggccuggaagcacgcccagcgcaucgagaccuggauccugcggcacccgggcuucaccaucauggccgcgauccuggccuacaccaucgggaccacccacuuccagcggguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgccacggagaaggacucccccgugaacaucgaggcggagccgcccuucggggacagcuacaucaucaucggcgucgagccggggcagcugaagcucaacugguucaagaagggcuccagcaucgggcagauguucgagaccaccaugcgcggcgccaagcgcauggccauccugggcgacaccgccugggacuucgggucccugggcgggguguucacgagcaucggcaaggcccuccaccagguguucggggcgaucuacggcgccgccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggcgagcgccauccagaaggcccaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccacggagcugaaguacuccuggaagaccuggggcaaggcgaagaugcucagcaccgaguccuacaaccagaccuuccugaucgacggccccgagacggccgagugcccgaacaccaaccgcgccuggaacagccuggagguggaggacuacggguucggcguguucaccaccaacaucuggcucaagcugaaggagaagcaggacgccuucugcgacuccaagcugaugagcgccgcgaucaaggacaaccgggccguccacgccgacaugggguacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgcgggccccgucagccagcacaacuaccgcccgggguaccacacccagaucgccggccccuggcaccuggggaagcuggagauggacuucgacuucugcgacggcaccaccgugaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggucaacucccucgugaccgccggccacggccagguggacaacuucagccugggcguccugggcauggcccucuuccuggaggagaugcugcggacccgcguggggacgaagcacgccauccuccugguggccgucuccuucgugacccugaucaccggcaacaugagcuucaaggaccucgggcggguggucgugauggugggcgccaccauggccgacgacaucgggaugggcgucacguaccuggcgcugcucgccgccuucaaggugcgccccaccuucgccgccggccugcugcuccggaagcugaccuccaaggagcugaugaugaccacgaucgggaucgugcuccugagccaguccaccauccccgagaccguccuggagcucaccgacgcgcuggcccugggcaugauggugcucaagaucgugcgcaacauggagaaguaccagcuggccgucacgaucauggccauccugugcgugccgaacgccgucauccuccagaacgcguggaagguggggugcaccauccuggccguggucagcgugagcccccugcuccugaccagcucccagcagaagaccgacuggaucccccuggcccucacgaucaagggccugaaccccaccgccaucuuccugaccacccucagccgcacgaacaagaagcgguccuggccgcugaacgaggcgaucauggccgugggcauggucagcauccuggccuccagccuccugaagaacgacauccccaugaccgggccccugguggccggcgggcuccugaccgugugcuacguccugaccggccgcuccgccgaccucgagcuggagcgggcgacggacgugaagugggaggaccaggccgagaucagcggguccagccccauccugagcaucaccaucuccgaggacggcagcauguccaucaagaacgaggaggaggagcagacccucaccauccugauccgcacgggccugcucgugaucagcgggcuguucccgaucuccauccccaucaccgccgccgccugguaccugugggaggucaagaagcagcgggcgggcgugcucugggacgugcccuccccgccgcccauggggaaggccgagcuggaggacggcgccuaccgcaucaagcagaaggggauccugggcuacucccagaucggcgccggggucuacaaggagggcaccuuccacaccauguggcacgugacccgcggggcggugcucaugcacaagggcaagcgcaucgagcccagcugggcggacgucaagaaggaccugaucuccuacgggggcggcuggaagcuggagggggaguggaaggagggcgaggagguccaggugcucgcccuggagcccgggaagaacccccgggccguccagacgaagcccggccuguucaagaccaacaccgggaccaucggcgccgugagccucgacuucucccccggcacgagcgggucccccaucaucgacaagaagggcaagguggucgggcuguacggcaacggcguggugacccgcagcggggccuacgucuccgcgaucgcccagaccgagaaguccaucgaggacaaccccgagaucgaggacgacaucuuccggaagcgccggcugaccaucauggaccugcaccccggcgccgggaagacgaagcgcuaccuccccgccaucgugcgggaggcgaucaagcgcggccugcggacccugauccucgccccgacccgcguggucgccgccgagauggaggaggcccugcgggggcugcccauccgcuaccagacccccgcgauccgguccgagcacacgggccgcgagaucguggaccucaugugccacgccaccuucaccaugcgccugcugagccccgugcgggucccgaacuacaaccucaucaucauggacgaggcccacuucaccgaccccgccuccaucgccgcgcgcggcuacaucagcacgcggguggagaugggggaggccgccggcaucuucaugaccgccacgccgcccgggagccgcgacccguucccccaguccaacgcccccaucaucgacgaggagcgggagauccccgagcgcagcuggaacuccggccacgagugggugaccgacuucaaggggaagacggucugguucgugccgagcaucaaggcgggcaacgacaucgccgccugccugcggaagaacggcaagaaggugauccagcugucccgcaagaccuucgacagcgaguacgucaagacccggaccaacgacugggacuucguggugacgaccgacaucuccgagaugggggccaacuucaaggcggagcgcgucaucgacccccggcgcugcaugaagcccgugauccucaccgacggcgaggagcgggugauccuggccgggcccaugccggucacccacagcuccgccgcccagcgccggggccgcaucgggcggaaccccaagaacgagaacgaccaguacaucuacaugggcgagccccuggagaacgacgaggacugcgcccacuggaaggaggcgaagaugcuccuggacaacaucaacacgcccgagggcaucaucccgagcauguucgagcccgagcgcgagaagguggacgccaucgacggggaguaccggcugcgcggcgaggcccgcaagaccuucguggaccucaugcggcgcggggaccugcccgucuggcuggccuacaagguggccgcggagggcaucaacuacgccgaccggcgcuggugcuucgacgggaucaagaacaaccagauccucgaggagaacguggaggucgagaucuggaccaaggagggcgagcggaagaagcugaagccgcgcuggcuggacgcccggaucuacuccgacccccucgcccugaaggaguucaaggaguucgccgcgggccgcaagagccugacccucaaccugaucacggagauggggcggcugcccaccuucaugacccagaagacccgcgacgcccucgacaaccuggccgugcugcacacggccgaggcgggcgggcgggccuacaaccacgcccucuccgagcugcccgagacccuggagacccuccugcugcucacccugcuggccacggucaccggcggcaucuuccucuuccugaugagcgggcgcggcaucgggaagaugacccugggcaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacguggucaucgccauccugaccgugguggccgcgaccauggccaacgagaugggguuccuggagaagaccaagaaggaccucggccugggcuccaucgccacgcagcagccggagagcaacauccuggacaucgaccuccgccccgccuccgccuggacccuguacgcggucgccaccaccuucgugacgcccaugcugcggcacagcaucgagaacagcuccgugaacgucagccucaccgccaucgccaaccaggccaccgugcugauggggcugggcaagggguggccccucuccaagauggacaucggcgugccgcugcuggcgaucgggugcuacagccaggucaaccccaucacccucacggccgcccugcugcuccugguggcccacuacgcgaucaucggccccggccugcaggccaaggccacccgcgaggcccagaagcgggccgcggccgggaucaugaagaaccccaccguggacggcaucaccgucaucgaccucgacccgauccccuacgaccccaaguucgagaagcagcugggccaggugaugcugcucauccugugcgugacgcagguccugaugaugcgcaccaccugggcccucugcgaggcccugacccuggccacgggccccaucuccacccucugggaggggaacccgggccgguucuggaacaccaccaucgcggugagcauggccaacaucuuccgcggcuccuaccuggccggggccggccuccucuucagcaucaugaagaacacgaccaacacccggcgcgggaccggcaacaugggcgagacgcugggggagaaguggaagucccgccugaacgcccucggcaagagcgaguuccagaucuacaagcgguccgggauccaggagguggaccgcacccuggcgaaggagggcaucaagcgcggggagaccgaccaccacgccgucagccgcggcuccgccaagcugcggugguucguggagcgcaacauggugacccccgagggcaaggucguggaccucgggugcggccgcggcggguggagcuacuacugcgggggccugaagaacgugcgcgaggucaagggccugacgaagggcgggcccgggcacgaggagcccaucccgauguccaccuacggcuggaaccucgugcggcugcagagcgggguggacgucuucuucaucccgcccgagaagugcgacacccugcucugcgacaucggcgaguccagccccaacccgaccguggaggccggccgcacgcugcgggugcugaaccucgucgagaacuggcugaacaacaacacccaguucugcaucaaggugcugaaccccuacaugcccuccgugaucgagaagauggaggcgcugcagcgcaaguacgggggcgcccucguccggaacccgcugagccgcaacagcacccacgagauguacuggguguccaacgccagcgggaacaucguguccagcgucaacaugaucucccggaugcugaucaaccgcuucaccaugcggcacaagaaggccaccuacgagcccgacguggaccucggcagcgggacgcgcaacaucggcaccgaguccgagauccccaaccuggacaucaucggcaagcggaucgagaagaucaagcaggagcacgagaccagcuggcacuacgaccaggaccaccccuacaagaccugggccuaccacggguccuacgagacgaagcagaccggcagcgcguccagcauggugaacggggucgugcgccugcucaccaagccgugggacgugcugcccaccgucacgcagauggccaugaccgacaccacccccuucggccagcagcgcguguucaaggagaagguggacacgcggacccaggagcccaaggagggcaccaagaagcugaugaagaucaccgccgaguggcucuggaaggagcuggggaagaagaagacgccgcgcaugugcacccgggaggaguucacccgcaagguccgguccaacgccgcccugggcgcgaucuucaccgacgagaacaaguggaaguccgcccgcgaggccguggaggacucccgguucugggagcucguggacaaggagcgcaaccugcaccuggaggggaagugcgagacgugcgucuacaacaugaugggcaagcgggagaagaagcucggggaguucggcaaggccaagggcagccgcgccaucugguacauguggcugggggcgcgguuccuggaguucgaggcccucggcuuccugaacgaggaccacugguucucccgcgagaacagccuguccgggguggagggcgaggggcuccacaagcugggcuacauccugcgggacgucagcaagaaggagggcggggccauguacgccgacgacaccgcgggcugggacacccgcaucacccucgaggaccugaagaacgaggagauggugacgaaccacaugaagggggagcacaagaagcuggccgaggccaucuucaagcucaccuaccagaacaaggugguccgggugcagcgccccacgccccggggcaccgugauggacaucaucagccgccgggaccagcgcggguccggccaggucggcacguacgggcugaacaccuucaccaacauggaggcccagcugauccggcagauggagggcgaggggguguucaagaacauccagcaccucaccgugacggaggaggucgccgugcagaacuggcuggcgcgcgugggccgcgagcggcugagccgcauggccaucuccggcgacgacugcgucgugaagccccucgacgaccgguucgccaacgcccugaccgcccugaacgacauggggaagauccgcaaggacauccagcagugggagccgagcaagggcuggaacgacuggacccaggugcccuucugcucccaccacuuccacgagcucaucaugaaggacgggcggguccugguggugcccugccgcaaccaggacgagcugaucggccgggcgcgcaucagccagggggccggcuggucccuccgggagaccgccugccugggcaagagcuacgcccagauguggucccugauguacuuccaccgccgggaccuccgccuggccgcgaacgccaucugcagcgccguccccucccacugggugccgacgagccggaccaccugguccauccacgccaagcacgaguggaugaccaccgaggacaugcugacgguguggaaccgcgucuggauccgggagaaccccuggauggaggacaagacccccguggagagcugggaggagauccccuaccucgggaagcgcgaggaccaguggugcggcucccugaucgggcugaccagccgggccaccugggcgaagaacauccaggccgccaucaaccaggugcgcucccucaucggcaacgaggaguacacggacuacaugccgagcaugaagcgguuccgccgcgaggaggaggaggccgggguccugugguga

SEQ ID NO: 9520 - RNA, 9876 nt, Artificial Sequence
  derived and/or modified CDS sequence (opt1) from DENV-2__FJ024458__SS-prME
agcgccgggaugaucaucaugcugauccccaccgugauggccuuccaccucaccacccggaacggggagccccacaugaucgucgggauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcggagcgucgcccuggugccccacguggggaugggccucgagacgcggaccgagaccuggauguccagcgagggggccuggaagcacgcccagcgcaucgagaccuggauccugcggcaccccggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggcgccggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacauggacuacuggaucgaguccgcccucaacgacacguggaagaucgagaaggccagcuucaucgaggugaagaacugccacugggccaagucccacacccuguggagcaacgggguccuggaguccgagaugaucauccccaagaaccucgcgggccccgugagccagcacaacuaccggcugggcuaccacacccagaucgccgggcccuggcaccugggcaagcucgagauggacuucgacuucugcgacgggaccaccgugaucgucacggaggacugcggcaaccgcgggccgucccugcggaccaccaccgccagcggcaagcugaucacggaguggugcugccgcagcugcacccugccgccccugcgguaccgcggcgaggacgggugcugguacggcauggagauccggccccugaaggagaaggaggagaaccucgugaacucccuggugaccgccgggcacggccaggucgacaacuucagccugggggugcucggcauggcgcuguuccuggaggagaugcuccgcacccgggugggcacgaagcacgccauccugcuggucgccguguccuucgugacccucaucaccgggaacaugagcuucaaggaccugggccgcgucguggugauggucggggccaccauggccgacgacaucggcaugggggugacguaccuggcgcuccuggccgccuucaaggugcggccgaccuucgccgccggccugcuccugcgcaagcugaccuccaaggagcucaugaugaccacgaucggcaucguccugcugagccaguccaccauccccgagaccgugcucgagcugaccgacgcgcuggcccucgggaugauggugcugaagaucguccgcaacauggagaaguaccagcuggccgugacgaucauggccauccucugcguccccaacgccgugauccugcagaacgcguggaaggugagcugcaccauccuggccgucguguccgugagcccccuccugcugaccuccagccagcagaagaccgacuggaucccgcucgcccugacgaucaagggccugaaccccaccgccaucuuccucaccacccugucccggacgaacaagaagcgcagcuggccccugaacgaggcgaucauggccgucgggaugguguccauccucgccagcucccugcugaagaacgacauccccaugaccggcccgcucguggccggcgggcugcugaccgucugcuacgugcucaccggccggagcgccgaccuggagcuggagcgcgcgacggacgugaagugggaggaccaggccgagaucuccgggagcagccccauccucuccaucaccaucagcgaggacggcuccaugagcaucaagaacgaggaggaggagcagacccugaccauccugauccggacggggcuccuggucaucuccggccuguuccccaucagcauccccaucaccgccgccgccugguaccucugggaggugaagaagcagcgcgcgggcgugcugugggacgucccgagcccgccgcccauggggaaggccgagcuggaggacggcgccuaccggaucaagcagaaggggauccucggcuacagccagaucggggccggcguguacaaggagggcaccuuccacaccauguggcacgugacccgcggggccguccugaugcacaagggcaagcggaucgagccguccugggcggacgugaagaaggaccugaucagcuacgggggcggguggaagcucgagggcgaguggaaggagggcgaggaggugcagguccuggcccuggagcccgggaagaacccccgcgccgugcagacgaagccgggccucuucaagaccaacaccgggaccaucggcgccgugucccuggacuucagccccgggacguccggcagccccaucaucgacaagaagggcaaggucguggggcuguacggcaacgggguggucacccgguccggcgccuacgugagcgcgaucgcccagaccgagaaguccaucgaggacaaccccgagaucgaggacgacaucuuccgcaagcggcgccugaccaucauggaccuccacccgggcgccgggaagacgaagcgguaccugcccgccaucgugcgcgaggcgaucaagcggggccugcgcacccucauccuggcccccacccgggucguggccgccgagauggaggaggcccugcgcgggcuccccauccgguaccagaccccggcgauccgcgccgagcacacgggccgcgagaucguggaccugaugugccacgccaccuucaccaugcggcugcucagccccguccgcgugcccaacuacaaccugaucaucauggacgaggcccacuucaccgaccccgccuccaucgcggcccggggguacaucagcacgcgcguggagaugggcgaggccgccggcaucuucaugaccgccaccccgcccgggagccgggaccccuucccccaguccaacgcgccgaucaucgacgaggagcgcgagauccccgagcggagcuggaacuccggccacgagugggucaccgacuucaaggggaagacggugugguucgugcccagcaucaaggccggcaacgacaucgccgccugccugcgcaagaacgggaagaaggucauccagcucucccggaagaccuucgacagcgaguacgugaagacccgcaccaacgacugggacuucguggucacgaccgacaucuccgagaugggcgcgaacuucaaggccgagcgggugaucgacccccgccggugcaugaagccggugauccugaccgacggcgaggagcgcgucauccuggccgggcccaugcccgugacccacagcuccgccgcccagcggcgcggccggaucgggcgcaaccccaagaacgagaacgaccaguacaucuacaugggcgagccgcucgagaacgacgaggacugcgcgcacuggaaggaggccaagaugcugcuggacaacaucaacacgcccgaggggaucauccccagcauguucgagcccgagcgggagaagguggacgccaucgacggcgaguaccgccuccgcggcgaggcccggaagaccuucgucgaccugaugcgccgcggggaccugccgguguggcucgccuacaagguggcggccgagggcaucaacuacgccgaccgccgguggugcuucgacgggaucaagaacaaccagauccuggaggagaacgucgagguggagaucuggaccaaggagggcgagcgcaagaagcugaagccccgguggcucgacgcccgcaucuacuccgacccccuggcccugaaggaguucaaggaguucgcggccgggcgcaagagccucacccugaaccugaucacggagaugggccggcucccgaccuucaugacccagaagacccgggacgcccuggacaaccuggccguccuccacacggcggaggccggcgggcgcgccuacaaccacgcccuguccgagcugcccgagacccucgagacccugcugcuccugacccugcucgccacggugaccggcgggaucuuccuguuccugaugagcggccggggcaucgggaagaugacccucggcaugugcugcaucaucaccgcguccauccugcugugguacgcccagauccagccccacuggaucgccgccagcaucauccucgaguucuuccugaucgugcugcucauccccgagccggagaagcagcgcacgccccaggacaaccagcugacguacgucgugaucgccauccugaccguggucgcggccaccauggccaacgagaugggguuccucgagaagaccaagaaggacuucggccugggguccaucgccacgcagcagcccgagagcaacauccuggacaucgaccuccggcccgccuccgcguggacccuguacgccguggccaccaccuucgugacgccgaugcugcgccacagcaucgagaacagcuccgucaacgugagccucaccgccaucgccaaccaggcgaccgugcugaugggccugggcaagggguggccccucuccaagauggacaucggcgucccccugcuggccaucgggugcuacagccaggugaaccccaucacccucacggccgcccugcugcuccugguggcgcacuacgccaucaucggcccggggcugcaggccaaggccacccgggaggcccagaagcgcgcggccgccggcaucaugaagaaccccaccgucgacggcaucaccgugaucgaccucgaccccauccccuacgacccgaaguucgagaagcagcugggccaggugaugcugcucauccugugcgucacccaggugcugaugaugcggaccaccugggcccucugcgaggcccugacccuggcgacgggccccaucuccacccucugggaggggaaccccggccgcuucuggaacaccaccaucgccgugagcauggccaacaucuuccggggguccuaccuggccggcgccggccuccucuucagcaucaugaagaacacgaccaacacccgccgcgggaccggcaacaucggggagacgcugggcgagaaguggaagucccggcugaacgcgcucggcaagagcgaguuccagaucuacaagaaguccgggauccaggaggucgaccgcacccuggccaaggagggcaucaagcgcggggagaccgaccaccacgccgugagccgcggcuccgccaagcugcggugguucguggagcgcaacauggucacccccgaggggaaggugguggaccucggcugcggccgcggcggguggagcuacuacugcgggggccugaagaacguccgcgaggugaaggggcugacgaagggcggcccggggcacgaggagcccauccccauguccaccuacggcuggaaccucgugcggcugcagagcggggucgacguguucuucaucccgcccgagaagugcgacacccugcucugcgacaucggcgaguccagccccaaccccaccguggaggcggggcgcacgcugcggguccugaaccucguggagaacuggcugaacaacaacacccaguucugcaucaaggugcugaaccccuacaugcccuccgucaucgagaagauggaggcccugcagcgcaaguacggcggcgcccucgugcggaacccccugagccgcaacagcacccacgagauguacuggguguccaacgccagcgggaacaucgucuccagcgugaacaugaucucccggaugcugaucaaccgcuucaccaugcggcacaagaaggccaccuacgagcccgacguggaccucggcagcgggacgcgcaacaucggcaucgaguccgagaucccgaaccuggacaucaucgggaagcggaucgagaagaucaagcaggagcacgagaccagcuggcacuacgaccaggaccaccccuacaagaccugggcguaccacggcuccuacgagaccaagcagacgggcagcgccuccagcauggucaacgggguggugcgccugcucaccaagcccugggacguccugcccaccgugacccagauggccaugacggacaccaccccguucggccagcagcgcguguucaaggagaaggucgacacccggacgcaggagcccaaggaggggaccaagaagcugaugaagaucaccgccgaguggcucuggaaggagcugggcaagaagaagacgccccggaugugcacgcgggaggaguucacccgcaaggugcgguccaacgccgcgcugggcgccaucuucaccgacgagaacaaguggaaguccgcccgcgaggccguggaggacucccgguucugggagcucgucgacaaggagcgcaaccugcaccuggaggggaagugcgagaccugcguguacaacaugaugggcaagcgggagaagaagcucggggaguucggcaaggccaaggggagccgcgcgaucugguacauguggcugggcgcccgguuccuggaguucgaggcccucggcuuccugaacgaggaccacugguucucccgcgagaacagccuguccggggucgagggcgaggggcuccacaagcugggcuacauccugcgggacgugagcaagaaggagggcggggccauguacgcggacgacacggccggcugggacacccgcaucacccucgaggaccugaagaacgaggagauggugaccaaccacauggagggggagcacaagaagcuggccgaggccaucuucaagcucacguaccagaacaaggucgugcgggugcagcgccccaccccgcggggcaccgucauggacaucaucagccgccgggaccagcgcggguccggccagguggggaccuacggccugaacacguucaccaacauggaggcccagcugauccggcagauggagggcgaggggguguucaagaacauccagcaccucaccgucaccgaggagguggcggugcagaacuggcuggcccgcgucggccgcgagcggcugagccgcauggccaucuccggggacgacugcguggugaagccccucgacgaccgguucgccaacgcccugacggcgcugaacgacaugggcaagauccgcaaggacauccagcagugggagcccagcaagggcuggaacgacuggacccagguccccuucugcucccaccacuuccacgagcucaucaugaaggacgggcgggugcugguggucccgugccgcaaccaggacgagcugaucggccgggcccgcaucagccagggggccggcuggucccuccgggagaccgccugccugggcaagagcuacgcccagauguggucccugauguacuuccaccgccgggaccuccgccuggcggccaacgccaucugcagcgccgugcccucccacugggugcccaccagccggacgaccugguccauccacgccaagcacgaguggaugaccaccgaggacaugcugaccgucuggaaccgcguguggauccgggagaaccccuggauggaggacaagacgccgguggagagcugggaggagauccccuaccucggcaagcgcgaggaccaguggugcggcucccugaucgggcugaccagccgggcgaccugggccaagaacauccaggccgccaucaaccagguccgcucccucaucggcaacgaggaguacaccgacuacaugcccagcaugaagcgguuccgccgcgaggaggaggaggcgggggugcugugguga

SEQ ID NO: 9521 - RNA, 9876 nt, Artificial Sequence
  derived and/or modified CDS sequence (opt1) from DENV-2__FJ205880__SS-prME
agcgcgggcaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcgcagcgucgcccuggugccccacguggggaugggccucgagacccggaccgagaccuggaugagcagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccagcaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuccugcgacagcaagcugauguccgccgccaucaaggacaaccgggcggugcacgccgacaugggguacuggaucgagagcgcccucaacgacacguggaagaucgagaaggccuccuucaucgaggugaagaacugccacuggcccaagagccacacccugugguccaacggcguccuggagagcgagaugaucauccccaagaaccucgccggccccgugucccagcacaacuaccgcccgggguaccacacccagaucgcgggccccuggcaccuggggaagcuggagauggacuucgacuucugcgacggcaccaccgugaucgucacggaggacugcgggaaccggggccccagccuccgcaccaccaccgccagcggcaagcugaucacggaguggugcugccgguccugcacccugcccccgcuccgcuaccgcggggaggacggcugcugguacgggauggagauccgcccccugaaggagaaggaggagaaccuggugaacagccucgugaccgccggccacgggcaggucgacaacuucucccugggcgugcugggcauggcccucuuccuggaggagaugcugaagacccggguggggacgaagcacgcgauccuccuggucgccgugagcuucgugacccugaucaccggcaacauguccuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccagcaaggagcugaugaugaccacgaucgggaucguccuccugucccagagcaccauccccgagaccgugcuggagcucaccgacgcccuggcgcugggcaugauggugcucaagaucguccggaacauggagaaguaccagcuggccgugacgaucauggccauccugugcgucccgaacgccgugauccuccagaacgccuggaagguguccugcaccauccuggcggucgugagcgugagcccccugcuccugaccagcucccagcagaagaccgacuggaucccccuggcccucacgaucaaggggcugaaccccaccgccaucuuccugaccacccucagccgcacgaacaagaagcgcuccuggccgcugaacgaggccaucauggcggucggcauggugagcauccuggccuccagccuccugaagaacgacauccccaugaccggcccccugguggccgggggccuccugaccgucugcuacgugcugaccgggcgguccgccgaccucgagcuggagcgcgccacggacgugaagugggaggaccaggcggagaucagcggcagcucccccauccugagcaucaccaucuccgaggacgggagcauguccaucaagaacgaggaggaggagcagacccucaccauccugauccggacgggccugcucgucaucagcggccuguucccgaucuccauccccaucaccgccgccgccugguaccugugggaggugaagaagcagcgcgccggggugcucugggacguccccuccccgccgcccaugggcaaggcggagcuggaggacggggccuaccggaucaagcagaagggcauccugggguacucccagaucggcgccggcguguacaaggaggggaccuuccacaccauguggcacgugacccgcggcgccguccucaugcacaaggggaagcggaucgagcccagcugggccgacgugaagaaggaccugaucuccuacggcgggggcuggaagcuggagggcgaguggaaggagggggaggaggugcagguccucgcgcuggagcccggcaagaacccccgcgccgugcagacgaagcccgggcuguucaagaccaacaccggcaccaucggggccgugagccucgacuucucccccggcacgagcggcucccccaucaucgacaagaaggggaaggucgugggccuguacgggaacggcguggucacccggagcggcgccuacguguccgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccgggucguggccgccgagauggaggaggcccugcgcggccugcccauccgguaccagacccccgccauccgcgcggagcacacggggcgggagaucguggaccucaugugccacgccaccuucaccaugcgccugcugucccccguccgcgugccgaacuacaaccucaucaucauggacgaggcccacuucaccgaccccgccagcaucgccgcgcggggcuacaucagcacgcgcguggagaugggcgaggccgccgggaucuucaugaccgccacgccgcccggcucccgggacccguucccccagagcaacgcccccaucaucgacgaggagcgcgagauccccgagcgguccuggaacagcgggcacgagugggucaccgacuucaagggcaagacggugugguucgugccguccaucaaggcggggaacgacaucgccgccugccugcgcaagaacggcaagaaggucauccagcugagccggaagaccuucgacuccgaguacgugaagacccgcaccaacgacugggacuucguggucacgaccgacaucagcgagaugggcgccaacuucaaggcggagcgggugaucgacccccgccggugcaugaagcccgugauccucaccgacggggaggagcgcgucauccuggccggccccaugccggugacccacuccagcgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccguccauguucgagcccgagcgggagaagguggacgccaucgacggcgaguaccgccugcgcggggaggcccgcaagaccuucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacagcgacccccucgcccugaaggaguucaaggaguucgccgcgggccggaagucccugacccucaaccugaucacggagaugggccgccugcccaccuucaugacccagaagacccgggacgcccucgacaaccuggccguccugcacacggccgaggccggcgggcgcgccuacaaccacgcccucagcgagcugcccgagacccuggagacccuccugcugcucacccugcuggccacggugaccgggggcaucuuccucuuccugauguccggccgggggaucggcaagaugacccuggggaugugcugcaucaucaccgccagcauccuccugugguacgcgcagauccagccgcacuggaucgccgccuccaucauccuggaguucuuccucaucgugcugcugauccccgagcccgagaagcagcgcacgccccaggacaaccagcucacguacgucgugaucgccauccugaccguggucgccgcgaccauggccaacgagaugggcuuccuggagaagaccaagaaggaccucgggcugggcagcaucgccacgcagcagccggaguccaacauccuggacaucgaccuccggcccgccagcgccuggacccuguacgcgguggccaccaccuucgugacgcccaugcugcgccacagcaucgagaacuccagcgucaacgugucccucaccgccaucgccaaccaggccaccgugcugaugggccuggggaagggcuggccccucagcaagauggacaucggggucccgcugcuggcgaucggcugcuacucccaggugaaccccaucacccucacggccgcccugcugcuccugguggcccacuacgcgaucaucgggcccggccugcaggccaaggccacccgggaggcccagaagcgcgccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacggggcccaucagcacccucugggagggcaacccggggcgcuucuggaacaccaccaucgcgguguccauggccaacaucuuccggggcagcuaccuggccggcgccgggcuccucuucuccaucaugaagaacacgaccaacacccgccggggcaccgggaacaugggcgagacgcugggcgagaaguggaagucccgccugaacgcccucgggaaguccgaguuccagaucuacaagaaguccggcauccaggaggucgaccgcacccuggcgaaggaggggaucaagcggggcgagaccgaccaccacgccgugucccgcgggagcgccaagcugcggugguucguggagcgcaacauggucacccccgagggcaaggugguggaccucggcugcgggcggggcgggugguccuacuacugcggcgggcugaagaacguccgcgaggugaagggccugacgaagggcgggcccggccacgaggagcccaucccgaugagcaccuacggguggaaccucgugcggcugcaguccggcgucgacguguucuucaucccgcccgagaagugcgacacccugcucugcgacaucggggagagcucccccaacccgaccguggaggccggccgcacgcugcggguccugaaccucguggagaacuggcugaacaacaacacccaguucugcaucaaggugcugaaccccuacaugcccagcgucaucgagaagauggaggcgcugcagcgcaaguacggcggggcccucgugcggaacccgcugagccgcaacuccacccacgagauguacugggugagcaacgccuccggcaacaucgucagcuccgugaacaugaucagccggaugcugaucaaccgcuucaccaugcggcacaagaaggccaccuacgagcccgacguggaccucggguccggcacgcgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagaccaagcagacgggguccgcgagcuccauggucaacggcguggugcgccugcucaccaagccgugggacguccugcccaccgugacccagauggccaugacggacaccacccccuucgggcagcagcggguguucaaggagaaggucgacacccgcacgcaggagcccaaggagggcaccaagaagcugaugaagaucaccgccgaguggcucuggaaggagcugggcaagaagaagaccccgcgcaugugcacgcgggaggaguucacccgcaaggugcggagcaacgccgcccugggggcgaucuucaccgacgagaacaaguggaaguccgcccgcgaggccguggaggacagccgguucugggagcucgucgacaaggagcgcaaccugcaccuggagggcaagugcgagaccugcguguacaacaugauggggaagcgggagaagaagcucggcgaguucgggaaggccaagggcucccgcgccaucugguacauguggcugggcgcgcgguuccuggaguucgaggcccucggguuccugaacgaggaccacugguucagccgcgagaacucccugagcggcgucgagggggagggccuccacaagcugggguacauccugcgggacgugagcaagaaggagggcggcgccauguacgccgacgacacggcggggugggacacccgcaucacccucgaggaccugaagaacgaggagauggugaccaaccacauggagggcgagcacaagaagcuggccgaggccaucuucaagcucacguaccagaacaaggucgugcgggugcagcgccccacgccccgggggaccgucauggacaucaucucccgccgggaccagcgcggcagcggccagguggggaccuacggccugaacacguucaccaacauggaggcccagcugauccggcagauggagggggagggcguguucaagaacauccagcaccucaccgucaccgaggagguggccgugcagaacuggcuggcgcgcgucgggcgggagcgccugucccgcauggccaucagcggcgacgacugcguggugaagccccucgacgaccgguucgccaacgcccugacggcccugaacgacaugggcaagauccgcaaggacauccagcagugggagccguccaagggguggaacgacuggacccagguccccuucugcagccaccacuuccacgagcucaucaugaaggacggccgggugcuggugguccccugccgcaaccaggacgagcugaucgggcgggcgcgcaucucccagggcgccggguggagccuccgggagaccgccugccugggcaaguccuacgcccagauguggagccugauguacuuccaccgccgggaccuccgccuggccgcgaacgccaucugcuccgccgugcccagccacugggugccgaccucccggacgaccuggagcauccacgccaagcacgaguggaugaccaccgaggacaugcugaccgucuggaaccgcguguggauccgggagaaccccuggauggaggacaagacgcccguggaguccugggaggagauccccuaccucggcaagcgcgaggaccaguggugcgggagccugaucggccugaccucccgggccaccugggcgaagaacauccaggccgccaucaaccagguccgcagccucaucgggaacgaggaguacaccgacuacaugccgagcaugaagcgguuccgccgggaggaggaggaggccggcgugcugugguga

SEQ ID NO: 9522 - RNA, 9876 nt, Artificial Sequence
  derived and/or modified CDS sequence (opt1) from DENV-2__FJ390387__SS-prME
agcgccgggaugaucaucaugcugauccccaccgugauggccuuccaccucaccacccgcaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagguccccuucgagaucauggaccuggagaagcgcuacgugcucggccggcugaucaccgugaacccgaucgucacggagaaggacucccccgugaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcggggucuucacgagcaucggcaaggcccuccaccagguguucggggccaucuacggcgcggccuucuccggcgugagcuggaccaugaagauccugaucggggucaucaucaccuggaucggcaugaacucccggagcaccucccugagcgugucccuggugcucgucgggaucgugacgcuguaccugggcgugaugguccaggccgacagcgggugcgugguguccuggaagaacaaggagcucaagugcggcagcggcaucuucaucaccgacaacguccacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggaggucgaggacuacggguucggcguguucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgucaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgucaccgccggccacggccagguggacaacuucagccugggcgugcugggcauggcccucuuccuggaggagaugcugcggacccgcgucgggacgaagcacgcgauccuccugguggccguguccuucgucacccugaucaccggcaacaugagcuucaaggaccucgggcgggugguggucauggugggcgccaccaugacggacgacaucgggaugggcgugaccuaccuggcccugcucgccgcguucaagguccgccccaccuucgccgccggccugcugcuccggaagcugaccuccaaggagcugaugaugacgaccaucgggaucgugcuccugagccaguccaccauccccgagaccgugcuggagcucacggacgcccuggcccugggcaugaugguccucaagaucgugcgcaacauggagaaguaccagcuggcggucaccaucauggccauccugugcgugccgaacgccgugauccuccagaacgccuggaaggucagcugcaccauccuggccgugguguccgucagcccccugcuccugaccuccagccagcagaagacggacuggaucccccuggcgcucaccaucaaggggcugaaccccaccgccaucuuccugaccacgcucucccgcaccaacaagaagcggagcuggccgcugaacgaggccaucauggccgugggcaugguguccauccuggcgagcucccuccugaagaacgacauccccaugaccggcccccuggucgccgggggccuccugaccgugugcuacgugcugacggggcgcagcgccgaccucgagcuggagcgggccaccgacgucaagugggaggaccaggccgagaucuccggcagcagccccauccuguccaucaccaucagcgaggacggguccaugagcaucaagaacgaggaggaggagcagacccucacgauccugauccgcaccggccugcucgugaucuccggccuguucccgaucagcauccccaucaccgcggccgccugguaccugugggaggugaagaagcagcgggccgggguccucugggacgugcccagcccgccgcccaugggcaaggccgagcuggaggacggggcguaccgcaucaagcagaagggcauccugggguacagccagaucggcgccggcguguacaaggaggggaccuuccacaccauguggcacgucacgcggggcgccgugcucaugcacaaggggaagcgcaucgagcccuccugggccgacgugaagaaggaccugaucagcuacggcgggggcuggaagcuggagggcgaguggaaggagggggaggagguccaggugcucgcccuggagcccggcaagaacccccgggcggugcagaccaagcccgggcuguucaagaccaacaccggcacgaucggggccgucucccucgacuucagccccggcaccuccggcagccccaucaucgacaagaaggggaagguggugggccuguacgggaacggcgucgugacccgcuccggcgccuacgugagcgccaucgcccagaccgagaaguccaucgaggacaaccccgagaucgaggacgacaucuuccggaagcgccggcugacgaucauggaccugcaccccggggcgggcaagaccaagcgcuaccuccccgccaucguccgggaggccaucaagcgcgggcugcggacccugauccucgccccgacccgcgugguggcggccgagauggaggaggcccugcggggccugcccauccgcuaccagacgcccgccauccgggccgagcacaccgggcgcgagaucgucgaccucaugugccacgcgaccuucaccaugcgccugcugagccccgugcgggugccgaacuacaaccucaucaucauggacgaggcccacuucacggaccccgccuccaucgccgcccgcggcuacaucagcacccgggucgagaugggcgaggcggccgggaucuucaugaccgccacgccgcccggcagccgcgacccguucccccaguccaacgcccccaucaucgacgaggagcgggagauccccgagcgcagcuggaacuccgggcacgagugggugacggacuucaagggcaagaccgugugguucgucccgagcaucaaggccgggaacgacaucgcggccugccugcggaagaacggcaagaaggugauccagcugucccgcaagaccuucgacagcgaguacgugaagacccggacgaacgacugggacuucgucgugaccaccgacaucuccgagaugggcgccaacuucaaggccgagcgcgugaucgacccccggcgcugcaugaagcccgucauccucaccgacggggaggagcgggugauccuggcgggccccaugccggugacgcacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaaggucgacgcgaucgacggcgaguaccggcugcgcggggaggcccgcaagaccuucguggaccucaugcggcgcggcgaccugcccguguggcuggccuacaaggucgccgccgaggggaucaacuacgcggaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgccggccgcaagagccugacgcucaaccugaucaccgagaugggccggcugcccaccuucaugacccagaagacgcgcgacgcgcucgacaaccuggccgugcugcacaccgccgaggccgggggccgggcguacaaccacgcccucuccgagcugcccgagacccuggagacccuccugcugcucacgcugcuggccaccgugaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucaccuacguggugaucgccauccugaccgucguggccgccaccauggcgaacgagaugggcuuccuggagaagacgaagaaggaccucgggcugggcuccaucgccacccagcagccggagagcaacauccuggacaucgaccuccgccccgccuccgccuggacccuguacgccguggcgaccacguucgucacccccaugcugcggcacagcaucgagaacagcuccgugaacgugagccucaccgccaucgccaaccaggccaccguccugaugggccuggggaagggcuggccccucuccaagauggacaucggggugccgcugcuggccaucggcugcuacagccaggugaaccccaucacgcucaccgcggcccugcugcuccuggucgcccacuacgccaucaucgggcccggccugcaggcgaaggccacccgcgaggcccagaagcgggccgccgcgggcaucaugaagaaccccaccguggacgggaucacggugaucgaccucgacccgauccccuacgaccccaaguucgagaagcagcugggccaggucaugcugcucauccugugcgugacccaggugcugaugaugcgcaccaccugggcccucugcgaggcccugacgcuggccaccgggcccaucuccacccucugggagggcaacccggggcgguucuggaacaccacgaucgccgucagcauggcgaacaucuuccgcggcuccuaccuggccggcgccgggcuccucuucagcaucaugaagaacaccaccaacacccggcgcggcacggggaacaugggcgagacccugggcgagaaguggaagucccgccugaacgcccucgggaaguccgaguuccagaucuacaagaaguccggcauccaggagguggaccggacccuggccaaggaggggaucaagcgcggcgagaccgaccaccacgcggugagccggggguccgccaagcugcgcugguucgucgagcggaacauggugacgcccgagggcaagguggucgaccucggcugcgggcgcggcggguggagcuacuacugcggcgggcugaagaacgugcgggaggugaagggccugaccaagggcgggcccggccacgaggagcccaucccgauguccaccuacggguggaaccucguccgccugcagagcggcguggacguguucuucaucccgcccgagaagugcgacacccugcucugcgacaucggggaguccagccccaacccgacggucgaggccggccggacccugcgcgugcugaaccucguggagaacuggcugaacaacaacacccaguucugcaucaagguccugaaccccuacaugcccuccgugaucgagaagauggaggcccugcagcggaaguacggcggggcgcucgugcgcaacccgcugagccggaacagcacccacgagauguacugggucuccaacgccagcggcaacaucguguccagcgugaacaugaucucccgcaugcugaucaaccgguucaccaugcgccacaagaaggccacguacgagcccgacgucgaccucgggagcggcacccggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgugguccggcugcucaccaagccgugggacgugcugcccaccgugacgcagauggcgaugaccgacaccacccccuucgggcagcagcgcgucuucaaggagaagguggacacgcgcacccaggagcccaaggagggcaccaagaagcugaugaagaucaccgccgaguggcucuggaaggagcugggcaagaagaagacgccgcggaugugcacccgcgaggaguucacccggaaggugcgcuccaacgccgcccugggggccaucuucaccgacgagaacaaguggaaguccgcgcgggaggccgucgaggacucccgcuucugggagcucguggacaaggagcggaaccugcaccuggagggcaagugcgagacgugcgucuacaacaugauggggaagcgcgagaagaagcucggcgaguucgggaaggccaagggcagccgggccaucugguacauguggcugggcgcccgcuuccuggaguucgaggcgcucggguuccugaacgaggaccacugguucucccgggagaacagccuguccggcguggagggggagggccuccacaagcugggguacauccugcgcgacgugagcaagaaggagggcggcgccauguacgccgacgacaccgccgggugggacacccggaucacccucgaggaccugaagaacgaggagauggucacgaaccacauggagggcgagcacaagaagcuggcggaggccaucuucaagcucaccuaccagaacaagguggugcgcguccagcggcccacgccccgggggaccgugauggacaucaucagccggcgcgaccagcggggcuccggccagguggggacguacggccugaacaccuucaccaacauggaggcccagcugauccgccagauggagggggagggcgucuucaagaacauccagcaccucaccgugacggaggagguggccgucaagaacuggcuggcccggguggggcgcgagcgccugagccggauggcgaucuccggcgacgacugcguggucaagccccucgacgaccgcuucgccaacgcccugaccgcccugaacgacaugggcaagauccggaaggacauccagcagugggagccgagcaagggguggaacgacuggacccaggugcccuucugcucccaccacuuccacgagcucaucaugaaggacggccgcgugcuggucgugcccugccggaaccaggacgagcugguggggcgcgcccggaucagccagggcgcgggguggucccuccgcgagaccgccugccugggcaagagcuacgcccagauguggucccugauguacuuccaccggcgcgaccuccggcuggccgccaacgcgaucugcagcgccguccccucccacugggugccgacgagccgcaccaccugguccauccacgccaagcacgaguggaugaccaccgaggacaugcugacgguguggaaccgggucuggauccgcgagaaccccuggauggaggacaagacccccguggagagcugggaggagauccccuaccucggcaagcgggaggaccaguggugcgggucccugaucggccugaccagccgcgccaccugggccaagaacauccaggcggccaucaaccaggugcggucccucaucgggaacgaggaguacacggacuacaugccgagcaugaagcgcuuccggcgcgaggaggaggaggccggcguccugugguga

SEQ ID NO: 9523 - RNA, 9876 nt, Artificial Sequence
  derived and/or modified CDS sequence (opt1) from DENV-2__FJ024461__SS-prME
agcgccgggaugaucaucaugcugauccccaccgugauggccuuccaccucaccacccggaacggggagccccacaugaucgucgggauccaggagaaggggaagucccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacgugggcaugggccucgagacccggaccgagaccuggauguccagcgagggggccuggaagcacgcccagcgcaucgagaccuggauccugcggcaccccggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgccugggguaccacacccagaucgcgggcccguggcaccuggggaagcucgagauggacuucgacuucugcgacggcaccaccgugaucgucacggaggacugcgggaaccggggccccucccugcgcaccaccaccgccagcggcaagcugaucacggaguggugcugccggagcugcacccugccgccccugcgcuaccgcggggaggacggcugcugguacgggauggagauccgcccgcugaaggagaaggaggagaaccucgugaacucccuggugaccgccggccacgggcaggucgacaacuucagccugggcgugcucggcauggcccuguuccuggaggagaugcuccggacccgcguggggacgaagcacgcgauccugcuggucgccguguccuucgugacccucaucaccggcaacaugagcuucaaggaccuggggcgggucguggugauggucggcgccaccauggccgacgacaucgggaugggcgugacguaccuggcccuccuggcggccuucaaggugcgccccaccuucgccgccggccugcuccugcggaagcugaccuccaaggagcucaugaugaccacgaucgggaucguccugcugagccaguccaccauccccgagaccgugcucgagcugaccgacgcccuggcgcucggcaugauggugcugaagaucguccgcaacauggagaaguaccagcuggccgugacgaucauggccauccucugcguccccaacgccgugauccugcagaacgccuggaaggugagcugcaccauccuggcggucguguccgugagcccgcuccugcugaccuccagccagcagaagaccgacuggaucccccucgcccugacgaucaaggggcugaaccccaccgccaucuuccucaccacccugucccgcacgaacaagaagcggagcuggccccugaacgaggccaucauggcggucggcaugguguccauccucgccagcucccugcugaagaacgacaucccgaugaccggcccccucguggccgggggccugcugaccgucugcuacgugcucaccgggcgcagcgccgaccuggagcuggagcgggccacggacgugaagugggaggaccaggcggagaucuccggcagcagccccauccucuccaucaccaucagcgaggacggguccaugagcaucaagaacgaggaggaggagcagacccugaccauccugauccgcacgggccuccuggucaucuccggccuguuccccaucagcaucccgaucaccgccgccgccugguaccucugggaggugaagaagcagcgggccggggugcugugggacguccccagcccgccgcccaugggcaaggcggagcuggaggacggggccuaccgcaucaagcagaagggcauccucggguacagccagaucggcgccggcguguacaaggaggggaccuuccacaccauguggcacgugacccggggcgccguccugaugcacaaggggaagcgcaucgagcccuccugggccgacgugaagaaggaccugaucagcuacggcgggggcuggaagcucgagggcgaguggaaggagggggaggaggugcagguccuggcgcuggagcccggcaagaacccccgggccgugcagacgaagcccggccucuucaagaccaacaccggcaccaucggggccgugucccuggacuucagccccggcacguccggcagccccaucaucgacaagaaggggaaggucgugggccuguacgggaacggcguggucacccgcuccggcgccuacgugagcgccaucgcgcagaccgagaaggggaucgaggacaacccggagaucgaggacgacaucuuccggaagcgccggcugaccaucauggaccuccaccccggcgccgggaagacgaagcgcuaccugcccgccaucgugcgggaggccaucaagcgcggccugcggacccucauccuggcgcccacccgcgucguggccgccgagauggaggaggcccugcgggggcucccgauccgcuaccagacccccgccauccgggcggagcacacgggccgcgagaucguggaccugaugugccacgccaccuucaccaugcgccugcucucccccguccgggugcccaacuacaaccugaucaucauggacgaggcccacuucaccgacccggccagcaucgccgcgcgcggcuacaucuccacgcggguggagaugggggaggccgccggcaucuucaugaccgccacgccgcccgggagccgcgaccccuucccgcagagcaacgcccccaucaucgacgaggagcgggagauccccgagcgcuccuggaacagcggccacgagugggucaccgacuucaaggggaagacggugugguucgugcccuccaucaaggcgggcaacgacaucgccgccugccugcggaagaacggcaagaaggucauccagcucagccgcaagaccuucgacuccgaguacgugaagacccggaccaacgacugggacuucguggucacgaccgacaucagcgagaugggggccaacuucaaggcggagcgcgugaucgacccgcggcgcugcaugaagcccgugauccugaccgacggcgaggagcgggucauccuggccgggcccaugcccgugacccacuccagcgccgcccagcgccggggccgcaucgggcggaacccgaagaacgagaacgaccaguacaucuacaugggcgagccccucgagaacgacgaggacugcgcccacuggaaggaggcgaagaugcugcuggacaacaucaacacgcccgagggcaucauccccuccauguucgagccggagcgcgagaagguggacgccaucgacggggaguaccggcuccgcggcgaggcccgcaagaccuucgucgaccugaugcggcgcggggaccugcccguguggcucgccuacaagguggccgcggagggcaucaacuacgccgaccggcgcuggugcuucgacgggaucaagaacaaccagauccuggaggagaacgucgagguggagaucuggaccaaggagggcgagcggaagaagcugaagccccgcuggcucgacgcccggaucuacagcgacccgcuggcccugaaggaguucaaggaguucgccgcgggccgcaagucccucacccugaaccugaucacggagauggggcggcuccccaccuucaugacccagaagacccgcgacgcccuggacaaccuggccguccuccacacggccgaggcgggcgggcgggccuacaaccacgcccugagcgagcugcccgagacccucgagacccugcugcuccugacccugcucgccacggugaccggcggcaucuuccuguuccugauguccgggcgcggcaucgggaagaugacccucggcaugugcugcaucaucaccgccagcauccugcugugguacgcgcagauccagccccacuggaucgccgccuccaucauccucgaguucuuccugaucgugcugcucaucccggagcccgagaagcagcggacgccccaggacaaccagcugacguacgucgugaucgccauccugaccguggucgccgcgaccauggccaacgagaugggguuccucgagaagaccaagaaggacuucggccugggcagcaucgccacgcagcagcccgaguccaacauccuggacaucgaccuccgcccggccagcgccuggacccuguacgcgguggccaccaccuucgugacgcccaugcugcggcacuccaucgagaacagcagcgucaacgugucccucaccgccaucgccaaccaggccaccgugcugauggggcugggcaagggguggccccucagcaagauggacaucggcgucccccugcuggcgaucgggugcuacucccaggugaacccgaucacccucacggccgcccugcugcuccugguggcccacuacgcgaucaucggccccggccugcaggccaaggccacccgcgaggcccagaagcgggccgcggccgggaucaugaagaaccccaccgucgacggcaucaccgugaucgaccucgaccccaucccguacgaccccaaguucgagaagcagcugggccaggugaugcugcucauccugugcgucacccaggugcugaugaugcgcaccaccugggcccucugcgaggcccugacccuggccacgggccccaucagcacccucugggaggggaaccccggccgguucuggaacaccaccaucgcgguguccauggccaacaucuuccgcggcagcuaccuggccggggccggccuccucuucuccaucaugaagaacacgaccaacacccggcgcgggaccggcaacaucggcgagacgcugggggagaaguggaagucccgccugaacgcccucggcaagagcgaguuccagaucuacaagaaguccgggauccaggaggucgaccggacccuggcgaaggagggcaucaagcgcggggagaccgaccaccacgccgugucccggggcagcgccaagcugcgcugguucguggagcggaacauggucaccccggagggcaaggugguggaccucgggugcggccgcgggggcugguccuacuacugcgggggccugaagaacguccgggaggugaagggccugacgaagggcgggcccgggcacgaggagcccauccccaugagcaccuacggcuggaaccucgugcgccugcaguccggggucgacguguucuucaucccgcccgagaagugcgacacccugcucugcgacaucggcgagagcucccccaaccccaccguggaggccggccggacgcugcgcguccugaaccucguggagaacuggcugaacaacaacacccaguucugcaucaaggugcugaacccguacaugcccagcgucaucgagaagauggaggcgcugcagcggaaguacgggggcgcccucgugcgcaacccccugucccggaacagcacccacgagauguacugggugagcaacgccuccgggaacaucgucagcuccgugaacaugaucagccgcaugcugaucaaccgguucaccaugcgccacaagaaggccaccuacgagccggacguggaccucggcuccgggacgcggaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagaccaagcagacgggcuccgcgagcuccauggucaacgggguggugcggcugcucaccaagcccugggacguccugccgaccgugacccagauggccaugacggacaccacccccuucggccagcagcgcguguucaaggagaaggucgacacccgcacgcaggagcccaaggagggcaccaagaagcugaugaagaucaccgccgaguggcucuggaaggagcuggggaagaagaagacgccccggaugugcacgcgcgaggaguucacccggaaggugcgcagcaacgccgcccugggcgcgaucuucaccgacgagaacaaguggaaguccgcccgggaggccguggaggacagccgcuucugggagcucgucgacaaggagcggaaccugcaccuggaggggaagugcgagaccugcguguacaacaugaugggcaagcgcgagaagaagcucggggaguucggcaaggccaagggcucccgggccaucugguacauguggcugggggcgcgcuuccuggaguucgaggcccucggcuuccugaacgaggaccacugguucagccgggagaacucccugagcggggucgagggcgaggggcuccacaagcugggcuacauccugcgcgacguguccaagaaggagggcggggccauguacgccgacgacacggcgggcugggacacccggaucacccucgaggaccugaagaacgaggagauggugaccaaccacauggagggggagcacaagaagcuggccgaggccaucuucaagcucacguaccagaacaaggucgugcgcgugcagcggccgacgccccgcggcaccgucauggacaucaucagccggcgcgaccagcgggggagcggccaggugggcaccuacgggcugaacaccuucaccaacauggaggcccagcugauccgccagauggagggcgaggggguguucaagaacauccagcaccucaccgucaccgaggagguggccgugcagaacuggcuggcgcgggucggccgcgagcgccugucccggauggccaucagcggcgacgacugcguggugaagccccucgacgaccgcuucgccaacgcccugacggcccugaacgacauggggaagauccggaaggacauccagcagugggagcccuccaagggcuggaacgacuggacccaggucccguucugcagccaccacuuccacgagcucaucaugaaggacgggcgcgugcuggugguccccugccggaaccaggacgagcugaucggccgcgcgcggaucucccagggggccggcuggagccuccgcgagaccgccugccugggcaaguccuacgcccagauguggagccugauguacuuccaccggcgcgaccuccggcuggccgcgaacgccaucugcuccgccgugcccagccacugggugcccaccucccgcacgaccuggagcauccacgccaagcacgaguggaugaccaccgaggacaugcugaccgucuggaaccggguguggauccgcgagaacccguggauggaggacaagacgcccguggaguccugggaggagauccccuaccucgggaagcgggaggaccaguggugcggcagccugaucgggcugaccucccgcgccaccugggcgaagaacauccaggccgccaucaaccagguccggagccucaucggcaacgaggaguacaccgacuacaugcccuccaugaagcgcuuccggcgcgaggaggaggaggccggggugcugugguga

SEQ ID NO: 9524 - RNA, 9876 nt, Artificial Sequence
  derived and/or modified CDS sequence (opt1) from DENV-2__FJ373299__SS-prME
agcgcgggcaugaucaucaugcugauccccaccgugauggccuuccaccucaccacccggaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcggagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacucccggcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggccaucauggcggucggcaugguguccauccuggccagcucccuccugaagaacgacauccccaugaccggcccccugguggccgggggccuccugaccgucugcuacgugcugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgucaucuccggccuguucccgaucagcauccccaucaccgccgccgccugguaccugugggaggugaagaagcagcgcgccggggugcucugggacguccccagcccgccgcccaugggcaaggcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccgggucguggccgccgagauggaggaggcccugcgcggccugcccauccgguaccagacccccgccauccgcgcggagcacacggggcgcgagaucguggaccucaugugccacgccaccuucaccaugcggcugcugagccccguccgcgugccgaacuacaaccucaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagacggugugguucgugccgagcaucaaggcggggaacgacaucgccgccugccugcgcaagaacggcaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccucaccgacggggaggagcgcgucauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaagguggacgccaucgacggcgaguaccgccugcgcggggaggcccggaagaccuucgucgaccucaugcgccggggcgaccugcccguguggcuggccuacaagguggccgccggcgggaucaacuacgccgaccgccgguggugcuucgacgggaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagauggggcgccugcccaccuucaugacccagaagacccgggacgcccucgacaaccuggccguccugcacacggccgaggcgggcgggcgcgccuacaaccacgcccucuccgagcugcccgagacccuggagacccuccugcugcucacccugcuggccacggugaccggcggcaucuuccucuuccugaugagcgggcggggcaucgggaagaugacccugggcaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucacguacgucgugaucgccauccugaccguggucgccgcgaccauggccaacgagaugggguuccuggagaagaccaagaaggaccucggccugggcuccaucgccacgcagcagccggagagcaacauccuggacaucgaccuccggcccgccuccgccuggacccuguacgcgguggccaccaccuucgugacgcccaugcugcgccacagcaucgagaacagcuccgucaacgugagccucaccgccaucgccaaccaggccaccgugcugauggggcugggcaagggguggccccucuccaagauggacaucggcgucccgcugcuggcgaucgggugcuacagccaggugaaccccaucacccucacggccgcccugcugcuccugguggcccacuacgcgaucaucggccccggccugcaggccaaggccacccgggaggcccagaagcgcgccgcggccgggaucaugaagaaccccaccgucgacggcaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacgggccccaucuccacccucugggaggggaacccgggccgcuucuggaacaccaccaucgcggugagcauggccaacaucuuccggggcuccuaccuggccggggccggccuccucuucagcaucaugaagaacacgaccaacacccgccgcgggaccggcaacaugggcgagacgcugggggagaaguggaagucccggcugaacgcccucggcaagagcgaguuccagaucuacaagaaguccgggauccaggaggucgaccgcacccuggcgaaggagggcaucaagcgcggggagaccgaccaccacgccgugagccgcggcuccgccaagcugcggugguucguggagcgcaacauggucacccccgagggcaaggugguggaccucgggugcggccgcggcggguggagcuacuacugcggcgggcugaagaacguccgcgaggugaaggggcugacgaagggcgggcccgggcacgaggagcccaucccgauguccaccuacggcuggaaccucgugcggcugcagagcggggucgacguguucuucaucccgcccgagaagugcgacacccugcucugcgacaucggcgaguccagccccaacccgaccguggaggccggccgcacgcugcggguccugaaccucguggagaacuggcugaacaacaacacccaguucugcaucaaggugcugaaccccuacaugcccuccgucaucgagaagauggaggcgcugcagcgcaaguacgggggcgcccucgugcggaacccgcugagccgcaacagcacccacgagauguacuggguguccaacgccagcgggaacaucgucuccagcgugaacaugaucucccggaugcugaucaaccgcuucaccaugcggcacaagaaggccaccuacgagcccgacguggaccucggcagcgggacgcgcaacaucggcaucgaguccgagacccccaaccuggacaucaucggcaagcggaucgagaagaucaagcaggagcacgagaccagcuggcacuacgaccaggaccaccccuacaagaccugggccuaccacggguccuacgagacgaagcagaccggcagcgcguccagcauggucaacgggguggugcgccugcucaccaagccgugggacguccugcccaccgugacgcagauggccaugaccgacaccacccccuucggccagcagcgcguguucaaggagaaggucgacacgcggacccaggagcccaaggagggcaccaagaagcugaugaagaucaccgccgaguggcucuggaaggagcuggggaagaagaagacgccgcgcaugugcacccgggaggaguucacccgcaaggugcgguccaacgccgcccugggcgcgaucuucaccgacgagaacaaguggaaguccgcccgcgaggccguggaggacucccgguucugggagcucgucgacaaggagcgcaaccugcaccuggaggggaagugcgagacgugcguguacaacaugaugggcaagcgggagaagaagcucggggaguucggcaaggccaagggcagccgcgccaucugguacauguggcugggggcgcgguuccuggaguucgaggcccucggcuuccugaacgaggaccacugguucucccgcgagaacagccuguccggggucgagggcgaggggcuccacaagcugggcuacauccugcgggacgugagcaagaaggagggcggggccauguacgccgacgacaccgcgggcugggacacccgcaucacccucgaggaccugaagaacgaggagauggugacgaaccacauggagggggagcacaagaagcuggccgaggccaucuucaagcucaccuaccagaacaaggucgugcgggugcagcgccccacgccccggggcaccgucauggacaucaucagccgccgggaccagcgcggguccggccaggugggcacguacgggcugaacaccuucaccaacauggaggcccagcugauccggcagauggagggcgaggggguguucaagaacauccagcaccucaccgucacggaggagguggccgugcagaacuggcuggcgcgcgucggccgcgagcggcugagccgcauggccaucuccggcgacgacugcguggugaagccccucgacgaccgguucgccaacgcccugaccgcccugaacgacauggggaagauccgcaaggacauccagcagugggagccgagcaagggcuggaacgacuggacccagguccccuucugcucccaccacuuccacgagcucaucaugaaggacgggcgggugcuggugguccccugccgcaaccaggacgagcugaucggccgggcgcgcaucagccagggggccggcuggucccuccgggagaccgccugccugggcaagagcuacgcccagauguggucccugauguacuuccaccgccgggaccuccgccuggccgcgaacgccaucugcagcgccgugcccucccacugggugccgacgagccggaccaccugguccauccacgccaagcacgaguggaugaccaccgaggacaugcugacggucuggaaccgcguguggauccgggagaaccccuggauggaggacaagacccccguggagagcugggaggagauccccuaccucgggaagcgcgaggaccaguggugcggcucccugaucgggcugaccagccgggccaccugggcgaagaacauccaggucgccaucaaccaggugcgcucccucaucggcaacgaggaguacacggacuacaugccgagcaugaagcgguuccgccgcgaggaggaggaggccggggugcugugguga

SEQ ID NO: 9525 - RNA, 9876 nt, Artificial Sequence
  derived and/or modified CDS sequence (opt1) from DENV-2__FJ410193__SS-prME
agcgccgggaugaucaucaugcugauccccaccgugauggccuuccaccucaccacccggaacggggagccccacaugaucgugggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacgcggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucaucugcaagcacagcaugguggaccgcggcugggggaacggcugcggccuguucggcaagggcgggaucgugacgugcgccauguucacgugcaagaagaacauggagggcaagaucguccagcccgagaaccuggaguacaccaucguggugacgccccacuccggggaggagcacgcggucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggagaacaaggccuggcucgugcaccgccagugguuccuggaccugccccuccccuggcugccgggggccgacaagcaggaguccaacuggauccagaaggagacccuggugaccuucaagaacccccacgccaagaagcaggacgucgugguccucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggugaaggagaucgccgagacccagcacggcaccaucgucauccgggugcaguacgagggggacggcagccccugcaagauccccuucgagaucauggaccuggagaagcgcuacgugcucggccggcugaucaccgucaacccgaucgugacggagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccagguguucggggccaucuacggcgcggccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcguguucaccaccaacaucuggcucaagcugaaggagaagcaggacgccuucugcgacuccaagcugaugagcgccgccaucaaggacaaccgggcgguccacgccgacaugggguacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgccggccccgucagccagcacaacuaccgcccgggguaccacacccagaucgcgggccccuggcaccuggggaagcuggagauggacuucgacuucugcgacggcaccaccgugaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggucaacucccucgugaccgccggccacggccagguggacaacuucagccugggcguccugggcauggcccucuuccuggaggagaugcugcggacccgcguggggacgaagcacgcgauccuccugguggccgucuccuucgugacccugaucaccggcaacaugagcuucaaggaccucgggcggguggucgugauggugggcgccaccauggccgacgacaucgggaugggcgucacguaccuggcccugcucgcggccuucaaggugcgccccaccuucgccgccggccugcugcuccggaagcugaccuccaaggagcugaugaugaccacgaucgggaucgugcuccugagccaguccaccauccccgagaccguccuggagcucaccgacgcccuggcgcugggcaugauggugcucaagaucgugcgcaacauggagaaguaccagcuggccgucacgaucauggccauccugugcgugccgaacgccgucauccuccagaacgccuggaaggugagcugcaccauccuggcgguggucuccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcauggucuccauccuggccagcucccuccugaagaacgacauccccaugaccggcccccugguggccgggggccuccugaccgugugcuacguccugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggucaagaagcagcgggccggggugcucugggacgugcccagcccgccgcccaugggcaaggcggagcuggaggacggggccuaccgcaucaagcagaagggcauccugggguacagccagaucggcgccggcgucuacaaggaggggaccuuccacaccauguggcacgugacccggggcgccgugcucaugcacaaggggaagcgcaucgagcccuccugggccgacgucaagaaggaccugaucagcuacggcgggggcuggaagcuggagggcgaguggaaggagggggaggagguccaggugcucgcgcuggagcccggcaagaacccccgggccguccagacgaagcccgggcuguucaagaccaacaccggcaccaucggggccgugucccucgacuucagccccggcacguccggcagccccaucaucgacaagaaggggaagguggucggccuguacgggaacggcguggugacccgcuccggcgccuacgucagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcguggucgccgccgagauggaggaggcccugcggggccugcccauccgcuaccagacccccgccauccgggcggagcacacggggcgcgagaucguggaccucaugugccacgccaccuucaccaugcgccugcugagccccgugcgggucccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggucugguucgugccgagcaucaaggcggggaacgacaucgccgccugccugcggaagaacggcaagaaggugauccagcugucccgcaagaccuucgacagcgaguacgucaagacccggaccaacgacugggacuucguggugacgaccgacaucuccgagaugggcgccaacuucaaggcggagcgcgucaucgacccccggcgcugcaugaagcccgugauccucaccgacggggaggagcgggugauccuggccggccccaugccggucacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucguggaccucaugcggcgcggcgaccugcccgucuggcuggccuacaagguggccgcggaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccgugcugcacacggccgaggccggcgggcgggccuacaaccacgcccucuccgagcugcccgagacccuggagacccuccugcugcucacccugcuggccacggucaccgggggcaucuuccucuuccugaugagcggccgcgggaucggcaagaugacccuggggaugugcugcaucaccaccgccuccauccuccugugguacgcgcagauccagccgcacuggaucgccgccagcaucauccuggaguucuuccucaucgugcugcugauccccgagcccgagaagcagcggacgccccaggacaaccagcucaccuacguggucaucgccauccugaccgugguggccgcgaccauggccaacgagaugggcuuccuggagaagacgaagaaggaccucgggcugggcuccaucgccacccagcagccggagagcaacauccuggacaucgaccuccgccccgccuccgccuggacccuguacgcggucgccaccacguucgugacccccaugcugcggcacagcaucgagaacagcuccgugaacgucagccucaccgccaucgccaaccaggccaccgugcugaugggccuggggaagggcuggccccucuccaagauggacaucggggugccgcugcuggcgaucggcugcuacagccaggucaaccccaucacgcucaccgccgcccugcugcuccugguggcccacuacgcgaucaucgggcccggccugcaggccaaggccacccgcgaggcccagaagcgggccgcggccggcaucaugaagaaccccaccguggacgggaucacggucaucgaccucgacccgauccccuacgaccccaaguucgagaagcagcugggccaggugaugcugcucauccugugcgugacccagguccugaugaugcgcaccaccugggcccucugcgaggcccugacgcuggccaccgggcccaucuccacccucugggagggcaacccggggcgguucuggaacaccacgaucgcggugagcauggccaacaucuuccgcggcuccuaccuggccggcgccgggcuccucuucagcaucaugaagaacaccaccaacacccggcgcggcacggggaacaugggcgagacccugggcgagaaguggaagucccgccugaacgcccucgggaaguccgaguuccagaucuacaagcgguccggcauccaggagguggaccgcacccuggcgaaggaggggaucaagcggggcgagaccgaccaccacgccgucagccgcggguccgccaagcugcggugguucguggagcgcaacauggugacgcccgagggcaaggucguggaccucggcugcgggcggggcggguggagcuacuacugcggcgggcugaagaacgugcgcgaggucaagggccugaccaagggcgggcccggccacgaggagcccaucccgauguccaccuacggguggaaccucgugcggcugcagagcggcguggacgucuucuucaucccgcccgagaagugcgacacccugcucugcgacaucggggaguccagccccaacccgacgguggaggccggccgcacccugcgggugcugaaccucgucgagaacuggcugaacaacaacacccaguucugcaucaaggugcugaaccccuacaugcccuccgugaucgagaagauggaggcgcugcagcgcaaguacggcggggcccucguccggaacccgcugagccgcaacagcacccacgagauguacuggguguccaacgccagcggcaacaucguguccagcgucaacaugaucucccggaugcugaucaaccgcuucaccaugcggcacaagaaggccacguacgagcccgacguggaccucgggagcggcacccgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgcguccagcauggugaacggcgucgugcgccugcucaccaagccgugggacgugcugcccaccgucacgcagauggccaugaccgacaccacccccuucgggcagcagcgcguguucaaggagaagguggacacgcggacccaggagcccaaggagggcaccaagaagcugaugaagaucaccgccgaguggcucuggaaggagcugggcaagaagaagacgccgcgcaugugcacccgggaggaguucacccgcaagguccgguccaacgccgcccugggggcgaucuucaccgacgagaacaaguggaaguccgcccgcgaggccguggaggacucccgguucugggagcucguggacaaggagcgcaaccugcaccuggagggcaagugcgagacgugcgucuacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcguggagggggagggccuccacaagcugggguacauccugcgggacgucagcaagaaggagggcggcgccauguacgccgacgacaccgcggggugggacacccgcaucacccucgaggaccugaagaacgaggagauggugacgaaccacauggagggcgagcacaagaagcuggccgaggccaucuucaagcucaccuaccagaacaaggugguccgggugcagcgccccgcgccccgggggaccgugauggacaucaucagccgccgggaccagcgcggcuccgggcaggucggcaccuacggccugaacacguucaccaacauggaggcccagcugauccggcagauggagggggagggcguguucaagaacauccagcaccucaccgugaccgaggaggucgcggugcagaacuggcuggcccgcguggggcgcgagcggcugagccgcauggccaucuccggcgacgacugcgucgugaagccccucgacgaccgguucgccaacgcccugacggcgcugaacgacaugggcaagauccgcaaggacauccagcagugggagccgagcaagggguggaacgacuggacccaggugcccuucugcucccaccacuuccacgagcucaucaugaaggacggccggguccugguggugcccugccgcaaccaggacgagcugaucgggcgggcccgcaucagccagggcgccggguggucccuccgggagaccgccugccugggcaagagcuacgcccagauguggucccugauguacuuccaccgccgggaccuccgccuggcggccaacgccaucugcagcgccguccccucccacugggugccgaccagccggacgaccugguccauccacgccaagcacgaguggaugaccaccgaggacaugcugaccguguggaaccgcgucuggauccgggagaaccccuggauggaggacaagacgcccguggagagcugggaggagauccccuaccucggcaagcgcgaggaccaguggugcgggucccugaucggccugaccagccgggcgaccugggccaagaacauccaggccgccaucaaccaggugcgcucccucaucgggaacgaggaguacaccgacuacaugccgagcaugaagcgguuccgccgcgaggaggaggaggcgggcguccugugguga

SEQ ID NO: 9526 - RNA, 9876 nt, Artificial Sequence
  derived and/or modified CDS sequence (opt1) from DENV-2__FJ410195__SS-prME
agcgccgggaugaucaucaugcugauccccaccgugauggccuuccaccucaccacccggaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugaucgucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucaugaccauccugugcgucccgaacgccgugauccuccagaacgccuggaaggugagcugcaccauccuggccgucguguccgugagcccccugcuccugaccuccagccgccagaagacggacuggaucccccuggcgcucaccaucaaggggcugaaccccaccgccaucuuccugaccacgcucucccggaccaacaagaagcgcagcuggccgcugaacgaggccaucauggccgucggcaugguguccauccuggcgagcucccuccugaagaacgacauccccaugaccggcccccugguggccgggggccuccugaccgucugcuacgugcugacggggcggagcgccgaccucgagcuggagcgcgccaccgacgugaagugggaggaccaggccgagaucuccggcagcagccccauccuguccaucaccaucagcgaggacggguccaugagcaucaagaacgaggaggaggagcagacccucacgauccugauccggaccggccugcucgucaucuccggccugcugccgaucagcauccccaucaccgcggccgccugguaccucugggaggugaagaagcagcgcgccggggugcugugggacguccccagcccgccgcccaugggcaaggccgagcuggaggacggggcguaccggaucaagcagaagggcauccucggguacagccagaucggcgccggcguguacaaggaggggaccuuccacaccauguggcacgugacgcgcggcgccguccugaugcacaaggggaagcggaucgagcccuccugggccgacgugaagaaggaccugaucagcuacggcgggggcuggaagcucgagggcgaguggaaggagggggaggaggugcagguccuggcccuggagcccggcaagaacccccgcgcggugcagaccaagcccggccucuucaagaccaacaccggcacgaucggggccgugucccuggacuucagccccggcaccuccggcagccccaucaucgacaagaaggggaaggucgugggccuguacgggaacggcguggucacccgguccggcgccuacgugagcgccaucgcccagaccgagaaguccaucgaggacaaccccgagaucgaggacgacaucuuccgcaagcggcgccugacgaucauggaccuccaccccggggcgggcaagaccaagcgguaccugcccgccaucgugcgcgaggccaucaagcgggggcugcgcacccucauccuggccccgacccgggucguggcggccgagauggaggaggcccugcgcggccuccccauccgguaccagacgcccgccauccgcgccgagcacaccgggcgcgagaucguggaccugaugugccacgcgaccuucaccaugcggcugcucagccccguccgcgugccgaacuacaaccugaucaucauggacgaggcccacuucacggaccccgccuccaucgccgcccggggcuacaucagcacccgcguggagaugggcgaggcggccgggaucuucaugaccgccacgccgcccggcagccgggacccguucccccaguccaacgcccccaucaucgacgaggagcgcgagauccccgagcggagcuggaacuccgggcacgagugggucacggacuucaagggcaagaccgugugguucgugccgagcaucaaggccgggaacgacaucgcggccugccugcgcaagaacggcaagaaggucauccagcucucccggaagaccuucgacagcgaguacgugaagacccgcacgaacgacugggacuucguggucaccaccgacaucuccgagaugggcgccaacuucaaggccgagcgggugaucgacccccgccggugcaugaagcccgugauccugaccgacggggaggagcgcgucauccuggcgggccccaugccggugacgcacagcuccgccgcccagcggcgcgggcggaucggccgcaaccccaagaacgagaacgaccaguacaucuacaugggggagccccucgagaacgacgaggacugcgcccacuggaaggaggccaagaugcugcuggacaacaucaacacccccgagggcaucaucccgagcauguucgagcccgagcgggagaagguggacgcgaucgacggcgaguaccgccuccgcggggaggcccggaagaccuucgucgaccugaugcgccggggcgaccugcccguguggcucgccuacaagguggccgccgaggggaucaacuacgcggaccgccgguggugcuucgacggcaucaagaacaaccagauccuggaggagaacgucgagguggagaucuggaccaaggagggggagcgcaagaagcugaagccgcgguggcucgacgcccgcaucuacuccgacccccuggcccugaaggaguucaaggaguucgccgccggccggaagucccucacgcugaaccugaucaccgagaugggccgccuccccaccuucaugacccagaagacgcgggacgcgcuggacaaccuggccguccuccacaccgccgaggccgggggccgcgcguacaaccacgcccuguccgagcugcccgagacccucgagacccugcugcuccugacgcugcucgccaccgugaccgggggcaucuuccuguuccugaugagcggccgggggaucggcaagaugacccucgggaugugcugcaucaucaccgccuccauccugcugugguacgcccagauccagccgcacuggaucgcggccagcaucauccucgaguucuuccugaucgugcugcucauccccgagcccgagaagcagcgcacgccccaggacaaccagcugaccuacgucgugaucgccauccugaccguggucgccgccaccauggcgaacgagaugggcuuccucgagaagacgaagaaggaccuggggcugggcuccaucgccacccagcagccggagagcaacauccucgacaucgaccugcggcccgccuccgccuggacccuguacgccguggcgaccacguucgugacccccaugcuccgccacagcaucgagaacagcuccgucaacgugagccugaccgccaucgccaaccaggccaccgugcugaugggccucgggaagggcuggccccuguccaagauggacaucggggucccgcugcucgccaucggcugcuacagccaggugaaccccaucacgcugaccgcggcccugcuccugcugguggcccacuacgccaucaucgggcccggccuccaggcgaaggccacccgggaggcccagaagcgcgccgccgcgggcaucaugaagaaccccaccgucgacgggaucacggugaucgaccuggacccgauccccuacgaccccaaguucgagaagcagcugggccaggugaugcuccugauccugugcgucacccaggugcucaugaugcggaccaccugggcccugugcgaggcccugacgcucgccaccgggcccaucuccacccugugggagggcaacccggggcgcuucuggaacaccacgaucgccgugagcauggcgaacaucuuccggggcuccuaccuggccggcgccgggcuccuguucagcaucaugaagaacaccaccaacacccgccgcggcacggggaacaugggcgagacccugggcgagaaguggaagucccggcucaacgcccuggggaagaacgaguuccagaucuacaagaaguccggcauccaggaggucgaccgcacccuggccaaggaggggaucaagcggggcgagaccgaccaccacgcggugucccgcgggagcgccaagcuccggugguucguggagcgcaacauggucacgcccgagggcaaggugguggaccugggcugcgggcggggcgggugguccuacuacugcggcgggcugaagaacguccgcgaggugaagggccucaccaagggcgggcccggccacgaggagcccaucccgaugagcaccuacggguggaaccuggugcggcugcaguccggcgucgacguguucuucaucccgcccgagaagugcgacacccuccugugcgacaucggggagagcucccccaacccgacgguggaggccggccgcacccugcggguccucaaccugguggagaacuggcugaacaacaacacccaguucugcaucaaggugcugaaccccuacaugcccagcgucaucgagaagauggaggcccuccagcgcaaguacggcggggcgcuggugcggaacccgcugucccgcaacagcacccacgagauguacugggugagcaacgccuccggcaacaucgucagcuccgugaacaugaucagccggaugcucaucaaccgcuucaccaugcggcacaagaaggccacguacgagcccgacguggaccugggguccggcacccgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagacgaagcagaccggguccgccagcuccauggucaacggcguggugcgccuccugaccaagccgugggacguccugcccaccgugacgcagauggcgaugaccgacaccacccccuucgggcagcagcgcguguucaaggagaaggucgacacgcggacccaggagcccaaggagggcaccaagaagcucaugaagaucaccgccgaguggcuguggaaggagcugggcaagaagaagacgccgcgcaugugcacccgggaggaguucacccgcaaggugcggagcaacgccgcccucggggccaucuucaccgacgagaacaaguggaaguccgcgcgcgaggccguggaggacagccgguucugggagcuggucgacaaggagcgcaaccugcaccucgagggcaagugcgagacgugcguguacaacaugauggggaagcgggagaagaagcugggcgaguucgggaaggccaagggcucccgcgccaucugguacauguggcugggcgcccgguuccucgaguucgaggcgcugggguuccugaacgaggaccacugguucagccgcgagaacucccucagcggcgucgagggggagggccugcacaagcugggguacauccuccgggacguguccaagaaggagggcggcgccauguacgccgacgacaccgccgggugggacacccgcaucacccuggaggaccugaagaacgaggagauggugacgaaccacauggagggcgagcacaagaagcucgcggaggccaucuucaagcugaccuaccagaacaaggucgugcgggugcagcgccccacgccccgggggaccgucauggacaucaucagccgccgggaccagcgcggcagcggccagguggggacguacggccugaacaccuucaccaacauggaggcccagcucauccggcagauggagggggagggcguguucaagaacauccagcaccugaccgucacggaggagguggccgugcagaacuggcuggcccgcgucgggcgcgagcggcucucccgcauggcgaucagcggcgacgacugcguggugaagccccuggacgaccgguucgccaacgcccugaccgcccucaacgacaugggcaagauccgcaaggacauccagcagugggagccguccaagggguggaacgacuggacccagguccccuucugcagccaccacuuccacgagcugaucaugaaggacggccgggugcuggugguccccugccgcaaccaggacgagcucaucgggcgggcccgcaucucccagggcgcgggguggagccugcgggagaccgccugccugggcaaguccuacgcccagauguggagccucauguacuuccaccgccgggaccugcgccuggccgccaacgcgaucugcuccgccgugcccagccacugggugccgacgucccggaccaccuggagcauccacgccaagcacgaguggaugaccaccgaggacaugcucacggucuggaaccgcguguggauccgggagaaccccuggauggaggacaagacccccguggaguccugggaggagauccccuaccugggcaagcgcgaggaccaguggugcgggagccugaucggccucaccucccgggccaccugggccaagaacauccaggcggccaucaaccagguccgcagccugaucgggaacgaggaguacacggacuacaugccguccaugaagcgguuccgccgcgaggaggaggaggccggcgugcugugguga

SEQ ID NO: 9527 - RNA, 9876 nt, Artificial Sequence
  derived and/or modified CDS sequence (opt1) from DENV-2__FJ432726__SS-prME
agcgcggggaugaucaucaugcugauccccaccgugauggccuuccaccucaccacccgcaacggggagccccacaugaucguggggauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacauccgcggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgcgagccagcacaacuaccggccgggguaccacacccagaucgccggccccuggcaccuggggaagcuggagauggacuucgacuucugcgacggcaccaccgugaucgugacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggucaacucccucgugaccgccggccacggccagguggacaacuucagccugggcguccugggcauggcccucuuccuggaggagaugcugcgcacccggguggggacgaagcacgccauccuccugguggccgucuccuucgugacccugaucaccggcaacaugagcuucaaggaccucgggcgcguggucgugauggugggcgccaccauggccgacgacaucgggaugggcgucacguaccuggcgcugcucgccgccuucaaggugcggcccaccuucgccgccggccugcugcuccgcaagcugaccuccaaggagcugaugaugaccacgaucgggaucgugcuccugagccaguccaccauccccgagaccguccuggagcucaccgacgcgcuggcccugggcaugauggugcucaagaucgugcgcaacauggagaaguaccagcuggccgucacgaucauggccauccugugcgugccgaacgccgucauccuccagaacgcguggaaggugagcugcaccauccuggccguggucuccgugagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggcgaucauggccgugggcauggucuccauccuggccagcucccuccugaagaacgacauccccaugaccggcccccugguggccgggggccuccugaccgugugcuacguccugaccgggcggagcgccgaccucgagcuggagcgcgcgacggacgugaagugggaggaccaggccgagaucuccggcagcagccccauccuguccaucaccaucagcgaggacggguccaugagcaucaagaacgaggaggaggagcagacccucaccauccugauccggacgggccugcucgugaucuccggccuguucccgaucagcauccccaucaccgccgccgccugguaccugugggaggucaagaagcagcgcgcgggggugcucugggacgugcccagcccgccgcccaugggcaaggccgagcuggaggacggggccuaccggaucaagcagaagggcauccugggguacagccagaucggcgccggcgucuacaaggaggggaccuuccacaccauguggcacgugacccgcggcgccgugcucaugcacaaggggaagcggaucgagcccuccugggcggacgucaagaaggaccugaucagcuacggcgggggcuggaagcuggagggcgaguggaaggagggggaggagguccaggugcucgcccuggagcccggcaagaacccccgcgccguccagacgaagcccgggcuguucaagaccaacaccggcaccaucggggccgugucccucgacuucagccccggcacguccggcagccccaucaucgacaagaaggggaagguggucggccuguacgggaacggcguggugacccgguccggcgccuacgucagcgcgaucgcccagaccgagaaguccaucgaggacaaccccgagaucgaggacgacaucuuccgcaagcggcgccugaccaucauggaccugcaccccggggccggcaagacgaagcgguaccuccccgccaucgugcgcgaggcgaucaagcgggggcugcgcacccugauccucgccccgacccggguggucgccgccgagauggaggaggcccugcgcggccugcccauccgguaccagacccccgcgauccgcgccgagcacacggggcgcgagaucguggaccucaugugccacgccaccuucaccaugcggcugcugagccccgugcgcgucccgaacuacaaccucaucaucauggacgaggcccacuucaccgaccccgccuccaucgcggcccggggcuacaucagcacgcgcguggagaugggcgaggccgccgggaucuucaugaccgccacgccgcccggcagccgggacccguucccccaguccaacgcgcccaucaucgacgaggagcgcgagauccccgagcggagcuggaacuccgggcacgagugggugaccgacuucaagggcaagacggucugguucgugccgagcaucaaggccgggaacgacaucgccgccugccugcgcaagaacggcaagaaggugauccagcugucccggaagaccuucgacagcgaguacgucaagacccgcaccaacgacugggacuucguggugacgaccgacaucuccgagaugggcgcgaacuucaaggccgagcgggucaucgacccccgccggugcaugaagcccgugauccucaccgacggggaggagcgcgugauccuggccggccccaugccggucacccacagcuccgccgcccagcggcgcgggcggaucggccgcaaccccaagaacgagaacgaccaguacaucuacaugggggagccccuggagaacgacgaggacugcgcgcacuggaaggaggccaagaugcuccuggacaacaucaacacgcccgagggcaucaucccgagcauguucgagcccgagcgggagaagguggacgccaucgacggcgaguaccgccugcgcggggaggcccggaagaccuucguggaccucaugcgccggggcgaccugcccgucuggcuggccuacaagguggcggccgaggggaucaacuacgccgaccgccgguggugcuucgacggcaucaagaacaaccagauccucgaggagaacguggaggucgagaucuggaccaaggagggggagcgcaagaagcugaagccgcgguggcuggacgcccgcaucuacuccgacccccucgcccugaaggaguucaaggaguucgcggccggccggaagucccugacccucaaccugaucacggagaugggccgccugcccaccuucaugacccagaagacccgggacgcccucgacaaccuggccgugcugcacacggcggaggccgggggccgcgccuacaaccacgcccucuccgagcugcccgagacccuggagacccuccugcugcucacccugcuggccacggucaccgggggcaucuuccucuuccugaugagcggccgggggaucggcaagaugacccuggggaugugcugcaucaucaccgcguccauccuccugugguacgcccagauccagccgcacuggaucgccgccagcaucauccuggaguucuuccucaucgugcugcugauccccgagcccgagaagcagcgcacgccccaggacaaccagcucacguacguggucaucgccauccugaccgugguggcggccaccauggccaacgagaugggcuuccuggagaagaccaagaaggaccucgggcugggcuccaucgccacgcagcagccggagagcaacauccuggacaucgaccuccggcccgccuccgcguggacccuguacgccgucgccaccaccuucgugacgcccaugcugcgccacagcaucgagaacagcuccgugaacgucagccucaccgccaucgccaaccaggcgaccgugcugaugggccuggggaagggcuggccccucuccaagauggacaucggggugccgcugcuggccaucggcugcuacagccaggucaaccccaucacccucacggccgcccugcugcuccugguggcgcacuacgccaucaucgggcccggccugcaggccaaggccacccgggaggcccagaagcgcgcggccgccggcaucaugaagaaccccaccguggacgggaucaccgucaucgaccucgacccgauccccuacgaccccaaguucgagaagcagcugggccaggugaugcugcucauccugugcgugacgcagguccugaugaugcggaccaccugggcccucugcgaggcccugacccuggcgacggggcccaucuccacccucugggagggcaacccggggcgcuucuggaacaccaccaucgccgugagcauggccaacaucuuccggggcuccuaccuggccggcgccgggcuccucuucagcaucaugaagaacacgaccaacacccgccgcggcaccgggaacaucggcgagacgcugggcgagaaguggaagucccggcugaacgcgcucggcaagagcgaguuccagaucuacaagaaguccggcauccaggagguggaccgcacccuggccaaggaggggaucaagcggggcgagaccgaccaccacgccgucagccgcggguccgccaagcugcggugguucguggagcgcaacauggugacccccgagggcaaggucguggaccucggcugcgggcggggcggguggagcuacuacugcggcgggcugaagaacgugcgcgaggucaagggccugacgaagggcgggcccggccacgaggagcccaucccgauguccaccuacggguggaaccucgugcggcugcagagcggcguggacgucuucuucaucccgcccgagaagugcgacacccugcucugcgacaucggggaguccagccccaacccgaccguggaggcgggccgcacgcugcgggugcugaaccucgucgagaacuggcugaacaacaacacccaguucugcaucaaggugcugaaccccuacaugcccuccgugaucgagaagauggaggcccugcagcgcaaguacggcggggcccucguccggaacccgcugagccgcaacagcacccacgagauguacuggguguccaacgccagcggcaacaucguguccagcgucaacaugaucucccggaugcugaucaaccgcuucaccaugcggcacaagaaggccaccuacgagcccgacguggaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggcguaccacggcuccuacgagaccaagcagacggggagcgccuccagcauggugaacggcgucgugcgccugcucaccaagccgugggacgugcugcccaccgucacccagauggccaugacggacaccacccccuucgggcagcagcgcguguucaaggagaagguggacacccggacgcaggagcccaaggagggcaccaagaagcugaugaagaucaccgccgaguggcucuggaaggagcugggcaagaagaagaccccgcgcaugugcacgcgggaggaguucacccgcaagguccgguccaacgccgcgcugggggccaucuucaccgacgagaacaaguggaaguccgcccgcgaggccguggaggacucccgguucugggagcucguggacaaggagcgcaaccugcaccuggagggcaagugcgagaccugcgucuacaacaugauggggaagcgggagaagaagcucggcgaguucgggaaggccaagggcagccgcgcgaucugguacauguggcugggcgcccgguuccuggaguucgaggcccucggguuccugaacgaggaccacugguucucccgcgagaacagccuguccggcguggagggggagggccuccacaagcugggguacauccugcgggacgucagcaagaaggagggcggcgccauguacgcggacgacacggccgggugggacacccgcaucacccucgaggaccugaagaacgaggagauggugaccaaccacauggagggcgagcacaagaagcuggccgaggccaucuucaagcucacguaccagaacaaggugguccgggugcagcgccccacgccccgggggaccgugauggacaucaucagccgccgggaccagcgcggcuccgggcaggucggcaccuacggccugaacacguucaccaacauggaggcccagcugauccggcagauggagggggagggcguguucaagaacauccagcaccucaccgugaccgaggaggucgcggugcacaacuggcuggcccgcguggggcgcgagcggcugagccgcauggccaucuccggcgacgacugcgucgugaagccccucgacgaccgguucgccaacgcccugacggcgcugaacgacaugggcaagauccgcaaggacauccagcagugggagccgagcaagggguggaacgacuggacccaggugcccuucugcucccaccacuuccacgagcucaucaugaaggacggccggauccuggucgugcccugccgcaaccaggacgagcugaucgggcgggcccgcaucagccagggcgccggguggucccuccgggagaccgccugccugggcaagagcuacgcccagauguggucccugauguacuuccaccgccgggaccuccgccuggcggccaacgccaucugcagcgccgugcccucccacugggucccgaccagccggacgaccugguccauccacgccaagcacgaguggaugaccaccgaggacaugcugaccguguggaaccgcguguggauccgggagaaccccuggauggaggacaagacgcccgucgagagcugggaggagauccccuaccucggcaagcgcgaggaccaguggugcgggucccugaucggccugaccagccgggcgaccugggccaagaacauccaggccgccaucaaccaggugcgcucccucaucgggaacgaggaguacaccgacuacaugccgagcaugaagcgguuccgccgcgaggaggaggaggcgggcgugcugugguga

SEQ ID NO: 9528 - RNA, 9876 nt, Artificial Sequence
  derived and/or modified CDS sequence (opt1) from DENV-2__JF730049__SS-prME
agcgcggggaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacguggugggcaacgacacggggaagcacggccaggagaucaaggucaccccgcagagcuccaucaccgaggcggagcugaccggguacggcaccgugacgauggagugcagcccccggaccggccucgacuucaacgagauggugcugcugcagauggagaacaaggccuggcucguccaccgccagugguuccuggaccugccccuccccuggcugccgggggccgacaagcaggaguccaacuggauccagaaggagacccuggugaccuucaagaacccccacgccaagaagcaggacgucguggugcucggcagccaggagggggccaugcacacggcgcugaccggcgccaccgagauccagaugagcuccgggaaccuccucuucaccggccaccugaagugccggcugcgcauggacaagcuccagcugaagggcaugagcuacuccaugugcacggggaaguucaaggucgugaaggagaucgccgagacccagcacggcaccaucgugauccggguccaguacgagggggacggcagccccugcaagauccccuucgagaucauggaccuggagaagcgcuacgugcucggccggcugaucaccgugaacccgaucgucacggagaaggacucccccgugaacaucgaggccgagccgcccuucggggacagcuacaucaucaucggcguggagccggggcagcugaagcucaacugguucaagaagggcuccagcaucgggcagauguucgagaccaccaugcgcggcgccaagcgcauggcgauccugggcgacaccgccugggacuucgggucccugggcggggucuucacgagcaucggcaaggcccuccaccagguguucggggccaucuacggcgccgcguucuccggcgugagcuggaccaugaagauccugaucggggucaucaucaccuggaucggcaugaacucccggagcaccucccugagcgugucccuggugcucgucgggaucgugacgcuguaccugggcgugaugguccaggccgacagcgggugcgugguguccuggaagaacaaggagcucaagugcggcagcggcaucuucaucaccgacaacguccacaccuggaccgagcaguacaaguuccagcccgagagccccuccaagcuggccagcgccauccagaaggcgcaggaggaggggaucugcggcauccgcuccgugacgcggcuggagaaccucauguggaagcagaucacccccgagcugaaccacauccugaccgagaacgaggugaagcucaccaucaugacgggggacaucaagggcaucaugcaggccgggaagcgcagccugcggccgcagcccaccgagcugaaguacuccuggaagaccuggggcaaggccaagauguucagcaccgaguccuacaaccagacguuccucaucgacggccccgagaccgccgagugcccgaacaccaaccgcgccuggaacagccuggaggucgaggacuacggguucggcguguucaccacgaacaucuggcugaagcucaaggagaagcaggacgcguucugcgacuccaagcugaugagcgccgccaucaaggacaaccgggccgugcacgccgacaugggguacuggaucgaguccgcgcugaacgacaccuggaagaucgagaaggccagcuucaucgaggucaagaacugccacuggcccaagucccacacccucuggagcaacggcgugcuggaguccgagaugaucauccccaagaaccuggccggccccgugagccagcacaacuaccgcccgggguaccacacccagaucgccggccccuggcaccucgggaagcuggagauggacuucgacuucugcgacggcaccacggucaucgugaccgaggacugcgggaaccggggccccucccugcgcaccaccacggccagcggcaagcucaucaccgaguggugcugccggagcugcacccugcccccgcugcgcuaccgcggggaggacggcugcugguacgggauggagauccgcccccucaaggagaaggaggagaaccuggugaacucccuggucaccgcgggccacggccagguggacaacuucagccucggcgugcugggcauggcccuguuccucgaggagaugcugaagacgcgggucgggaccaagcacgccauccugcucguggccguguccuucgucacccugaucaccggcaacaugagcuucaaggaccuggggcgcgugguggucauggugggcgcgacgauggccgacgacaucgggaugggcgugaccuaccucgcccugcuggccgccuucaagguccggcccaccuucgcggccggccuccugcugcgcaagcucaccuccaaggagcugaugaugacgaccaucgggaucgugcugcucagccaguccaccauccccgagaccgugcuggagcugacggacgcccucgcccugggcaugaugguccugcggaucgugcgcaacauggagaaguaccagcucgccgucaccaucauggcgauccugugcgugccgaacgccgugauccugcagaacgccuggaaggucagcugcaccauccucgccgugguguccgucagcccccugcugcucaccuccagccagcagaagacggacuggaucccccuggcccugaccaucaaggggcucaaccccaccgcgaucuuccugaccacgcugucccgcaccaacaagaagcggagcuggccgcucaacgaggccaucauggccgugggcaugguguccauccuggccagcucccugcucaagaacgacauccccaugaccggcccccuggucgccggcgggcugcucaccgugugcuacgugcugacggggcgcagcgccgaccuggagcucgagcgggccaccgacgucaagugggaggaccaggccgagaucuccgggagcagccccauccuguccaucaccaucagcgaggacggguccaugagcaucaagaacgaggaggaggagcagacccugacgauccucauccgcaccggccugcuggugaucuccggccucuucccgaucagcauccccaucaccgccgcggccugguaccugugggaggugaagaagcagcgggccgggguccugugggacgugcccagcccgccgcccaugggcaaggccgagcucgaggacggggccuaccgcaucaagcagaagggcauccugggguacagccagaucggcgcgggcguguacaaggaggggaccuuccacaccauguggcacgucacgcggggcgccgugcugaugcacaaggggaagcgcaucgagcccuccugggccgacgugaagaaggaccucaucagcuacggcgggggcuggaagcuggagggcgaguggaaggagggggaggagguccaggugcuggcccucgagcccggcaagaacccccgggccgugcagaccaagcccgggcuguucaagaccuccaccggcacgaucggggcggucagccuggacuucucccccggcaccagcggcucccccaucaucgacaagaaggggaagguggugggccucuacgggaacggcgucgugacccgcagcggcgccuacguguccgccaucgcccagaccgagaaguccaucgaggacaaccccgagaucgaggacgacaucuuccggaagcgccggcugacgaucauggaccugcaccccggggccggcaagaccaagcgcuaccugcccgcgaucguccgggaggccaucaagcgcgggcuccggacccugauccuggccccgacccgcgugguggccgcggagauggaggaggcccuccggggccugcccauccgcuaccagacgcccgccauccgggccgagcacaccgggcgcgagaucgucgaccugaugugccacgccaccuucaccaugcgccuccugucccccgugcgggugccgaacuacaaccugaucaucauggacgaggcgcacuucacggaccccgccagcaucgccgcccgcggcuacaucagcacccgggucgagaugggcgaggccgcggggaucuucaugaccgccacgccgcccggcucccgcgacccguucccccagagcaacgcccccaucaucgacgaggagcgggagauccccgagcgcuccuggaacagcgggcacgagugggugacggacuucaagggcaagaccgugugguucgucccguccaucaaggccgggaacgacaucgccgcgugccuccggaagaacggcaagaaggugauccagcugagccgcaagaccuucgacuccgaguacgugaagacccggacgaacgacugggacuucgucgugaccaccgacaucagcgagaugggcgccaacuucaaggccgagcgcgugaucgacccccggcgcugcaugaagcccgucauccugaccgacggggaggagcgggugauccucgccggccccaugccggugacgcacuccagcgcggcccagcgccgggggcgcaucggccggaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgcgagaaggucgacgccaucgacggcgaguaccggcugcgcggggaggcgcgcaagaccuucguggaccugaugcggcgcggcgaccuccccguguggcuggccuacaaggucgccgccgaggggaucaacuacgccgaccggcgcuggugcuucgacggcaucaagaacaaccagauccuggaggagaacguggaggucgagaucuggaccaaggagggggagcggaagaagcucaagccgcgcuggcuggacgcgcggaucuacagcgacccccuggcccucaaggaguucaaggaguucgccgccggccgcaagucccugacgcugaaccucaucaccgagaugggccggcugcccaccuucaugacccagaagacgcgcgacgcccuggacaaccucgcggugcugcacaccgccgaggccgggggccgggccuacaaccacgcgcugagcgagcuccccgagacccuggagacccugcuccugcugacgcuccuggccaccgugaccgggggcaucuuccuguuccucauguccggccgcgggaucggcaagaugacccuggggaugugcugcaucaucaccgccagcauccugcucugguacgcccagauccagccgcacuggaucgccgcguccaucauccuggaguucuuccugaucguccuccugauccccgagcccgagaagcagcggacgccccaggacaaccagcugaccuacguggugaucgccauccucaccgucguggccgccaccauggccaacgagaugggcuuccuggagaagacgaagaaggaccuggggcucggcagcaucgcgacccagcagccggaguccaacauccuggacaucgaccugcgccccgccagcgccuggacccucuacgccguggccaccacguucgucacccccaugcugcggcacagcaucgagaacuccagcgugaacgugucccugaccgcgaucgccaaccaggccaccguccucaugggccuggggaagggcuggccccugagcaagauggacaucggggugccgcuccuggccaucggcugcuacucccaggugaaccccaucacgcugaccgccgcgcuccugcugcucgucgcccacuacgccaucaucgggcccggccugcaggccaaggcgacccgcgaggcccagaagcgggccgccgccggcaucaugaagaaccccaccguggacgggaucacggugaucgaccuggacccgauccccuacgaccccaaguucgagaagcagcucggccaggucaugcugcugauccucugcgugacccaggugcugaugaugcgcaccaccugggcgcugugcgaggcccucacgcuggccaccgggcccaucagcacccugugggagggcaacccggggcgguucuggaacaccacgaucgccgucuccauggccaacaucuuccgcggcagcuaccucgcgggcgccgggcugcuguucuccaucaugaagaacaccaccaacacccggcgcggcacggggaacaugggcgagacccucggcgagaaguggaagucccgccugaacgcccuggggaaguccgaguuccagaucuacaagaaguccggcauccaggagguggaccggacccucgccaaggaggggaucaagcgcggcgagaccgaccaccacgccgugucccgggggagcgcgaagcugcgcugguucgucgagcggaacauggugacgcccgagggcaagguggucgaccugggcugcgggcgcggcgggugguccuacuacugcggcgggcucaagaacgugcgggaggugaagggccugaccaagggcgggcccggccacgaggagcccaucccgaugagcaccuacggguggaaccugguccgccuccaguccggcguggacguguucuucaucccgcccgagaagugcgacacccugcugugcgacaucggggagagcucccccaacccgacggucgaggccggccggacccuccgcgugcugaaccugguggagaacuggcucaacaacaacacccaguucugcaucaagguccugaaccccuacaugcccagcgugaucgagaagauggaggcccugcagcggaaguacggcggggcccuggugcgcaacccgcucagccggaacuccacccacgagauguacugggucagcaacgcguccggcaacaucgugagcuccgugaacaugaucagccgcaugcugaucaaccgguucaccaugcgccacaagaaggccacguacgagcccgacgucgaccugggguccggcacccggaacaucgggaucgagagcgagauccccaaccucgacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgugguccggcugcugaccaagccgugggacgugcuccccaccgugacgcagauggccaugaccgacaccacccccuucgggcagcagcgcgucuucaaggagaagguggacacgcgcacccaggagcccaaggagggcaccaagaagcugaugaagaucaccgcggaguggcuguggaaggagcucggcaagaagaagacgccgcggaugugcacccgcgaggaguucacccggaaggugcgcagcaacgccgcccugggggccaucuucaccgacgagaacaaguggaaguccgcccgggaggcggucgaggacagccgcuucugggagcugguggacaaggagcggaaccuccaccuggagggcaagugcgagacgugcgucuacaacaugauggggaagcgcgagaagaagcugggcgaguucgggaaggccaagggcucccgggccaucugguacauguggcucggcgcccgcuuccuggaguucgaggcccugggguuccucaacgaggaccacugguucagccgggagaacucccugagcggcguggagggggagggccugcacaagcucggguacauccugcgcgacgugagcaagaaggagggcggcgcgauguacgccgacgacaccgccgggugggacacccggaucacccuggaggaccucaagaacgaggagauggucacgaaccacauggagggcgagcacaagaagcuggccgaggcgaucuucaagcugaccuaccagaacaagguggugcgcguccagcggcccacgccccgggggaccgugauggacaucaucucccggcgcgaccagcggggcagcggccagguggggacguacggccucaacaccuucaccaacauggaggcccagcugauccgccagauggagggggagggcgucuucaagaacauccagcaccugaccgugacggaggagguggccguccagaacuggcucgcccggguggggcgcgagcgccugucccggauggccaucagcggcgacgacugcguggucaagccccuggacgaccgcuucgcgaacgcccucaccgcccugaacgacaugggcaagauccggaaggacauccagcagugggagccguccaagggguggaacgacuggacccaggugcccuucugcagccaccacuuccacgagcugaucaugaaggacggccgcgugcucgucgugcccugccggaaccaggacgagcugaucgggcgcgcccggaucucccagggcgccggguggagccugcgcgagaccgcgugccucggcaaguccuacgcccagauguggagccugauguacuuccaccggcgcgaccugcggcucgccgccaacgccaucugcuccgcggugcccagccacugggucccgacgucccgcaccaccuggagcauccacgccaagcacgaguggaugaccaccgaggacaugcugacgguguggaaccggguguggauccgcgagaaccccuggauggaggacaagacccccgucgaguccugggaggagauccccuaccugggcaagcgggaggaccaguggugcgggagccucaucggccugaccucccgcgccaccugggccaagaacauccaggccgcgaucaaccaggugcggagccugaucgggaucgaggaguacacggacuacaugccgagcaugaagcgcuuccggcgcgaggaggaggaggccggcgugcucugguga

SEQ ID NO: 9529 - RNA, 9876 nt, Artificial Sequence
  derived and/or modified CDS sequence (opt1) from DENV-2__FJ562098__SS-prME
agcgcggggaugaucaucaugcugauccccaccgugauggccuuccaccucaccacccgcaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacgcggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgccacggagaaggacucccccgugaacaucgaggcggagccgcccuucggggacagcuacaucaucaucggcgucgagccggggcagcugaagcucaacugguucaagaagggcuccagcaucgggcagauguucgagaccaccaugcgcggcgccaagcgcauggccauccugggcgacaccgccugggacuucgggucccugggcgggguguucacgagcaucggcaaggcccuccaccagguguucggggcgaucuacggcgccgccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggcgagcgccauccagaaggcccaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccaucgagcugaaguacuccuggaagacguggggcaaggcgaagaugcucagcaccgagucccacaaccagaccuuccugaucgacggccccgagaccgccgagugcccgaacacgaaccgcgccuggaacagccuggagguggaggacuacggguucggcguguucaccaccaacaucuggcuccggcugaaggagaagcaggacgccuucugcgacuccaagcugaugagcgccgcgaucaaggacaaccgcgccguccacgccgacaugggguacuggaucgaguccgcccucaacgacaccuggaagaucgagaaggccagcuucaucgaggugaagaacugccacuggcccaagucccacacgcuguggagcaacggcgugcuggaguccgagauggucauccccaagaaccucgcgggccccgugagccagcacaacuaccggccgggguaccacacccagaucgccggccccuggcaccuggggaagcuggagauggacuucgacuucugcgacggcaccaccgugaucgucaccgaggacugcgggaaccgcggccccucccuccggacgaccaccgccagcggcaagcugaucaccgaguggugcugccgcagcugcacgcugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggaccaagcacgccauccuccuggucgccguguccuucgugacgcugaucaccggcaacaugagcuucaaggaccucgggcgcgucguggugauggucggcgccaccauggccgacgacaucgggaugggcgugaccuaccuggcgcugcucgccgccuucaaggugcggcccacguucgccgccggccugcugcuccgcaagcugaccuccaaggagcugaugaugaccaccaucgggaucguccuccugagccaguccacgauccccgagaccgugcuggagcucaccgacgcgcuggcccugggcaugauggugcucaagaucguccgcaacauggagaaguaccagcuggccgugaccaucauggccauccugugcgucccgaacgccgugauccuccagaacgcguggaaggugagcugcacgauccuggccgucguguccgugagcccccugcuccugaccuccagccagcagaagaccgacuggaucccccuggcccucaccaucaaggggcugaaccccacggccaucuuccugaccacccucucccggaccaacaagaagcgcagcuggccgcugaacgaggcgaucauggccgucggcaugguguccauccuggccagcucccuccugaagaacgacauccccaugacgggcccccugguggccgggggccuccugaccgucugcuacgugcugaccgggcggagcgccgaccucgagcuggagcgcgcgaccgacgugaagugggaggaccaggccgagaucuccggcagcagccccauccuguccaucacgaucagcgaggacggguccaugagcaucaagaacgaggaggaggagcagacccucaccauccugauccggaccggccugcucgucaucuccggccuguucccgaucagcauccccaucacggccgccgccugguaccugugggaggugaagaagcagcgcgcgggggugcucugggacguccccagcccgccgcccaugggcaaggccgagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggcggacgugaagaaggaccugaucagcuacggcgggggcuggaagcuggagggcgaguggaaggagggggaggaggugcagguccucgcccuggagcccggcaagaacccccgcgccgugcagaccaagcccgggcuguucaagacgaacaccggcaccaucggggccgugucccucgacuucagccccggcaccuccggcagccccaucaucgacaagaaggggaaggucgugggccuguacgggaacggcguggucacgcgguccggcgccuacgugagcgcgaucgcccagaccgagaaguccaucgaggacaaccccgagaucgaggacgacaucuuccgcaagcggcgccugaccaucauggaccugcaccccggggccggcaagaccaagcgguaccuccccgccaucgugcgcgaggcgaucaagcgggggcugcgcacgcugauccucgccccgacccgggucguggccgccgagauggaggaggcccugcgcggccugcccauccgguaccagacccccgcgauccgcgccgagcacaccgggcgcgagaucguggaccucaugugccacgccacguucaccaugcggcugcugagccccguccgcgugccgaacuacaaccucaucaucauggacgaggcccacuucaccgaccccgccuccaucgcggcccggggcuacaucagcacccgcguggagaugggcgaggccgccgggaucuucaugacggccacgccgcccggcagccgggacccguucccccaguccaacgcgcccaucaucgacgaggagcgcgagauccccgagcggagcuggaacuccgggcacgagugggucaccgacuucaagggcaagaccgugugguucgugccgagcaucaaggccgggaacgacaucgccgccugccugcgcaagaacggcaagaaggucauccagcugucccggaagacguucgacagcgaguacgugaagacccgcaccaacgacugggacuucguggucaccacggacaucuccgagaugggcgcgaacuucaaggccgagcgggugaucgacccccgccggugcaugaagcccgugauccucaccgacggggaggagcgcgucauccuggccggccccaugccggugacccacagcuccgccgcccagcggcgcgggcggaucggccgcaaccccaagaacgagaacgaccaguacaucuacaugggggagccccuggagaacgacgaggacugcgcgcacuggaaggaggccaagaugcuccuggacaacaucaacacccccgagggcaucaucccgagcauguucgagcccgagcgggagaagguggacgccaucgacggcgaguaccgccugcgcggggaggcccggaagacguucgucgaccucaugcgccggggcgaccugcccguguggcuggccuacaagguggcggccgaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgcggccggccggaagucccugacccucaaccugaucaccgagaugggccgccugcccacguucaugacccagaagacccgggacgcccucgacaaccuggccguccugcacaccgcggaggccgggggccgcgccuacaaccacgcccucuccgagcugcccgagacgcuggagacccuccugcugcucacccugcuggccaccgugaccggcgggaucuuccucuuccugaugagcgggcgggggaucggcaagaugacccuggggaugugcugcaucaucaccgcguccauccuccugugguacgcccagauccagccgcacuggaucgccgccagcaucauccuggaguucuuccucaucgugcugcugauccccgagcccgagaagcagcgcacgccccaggacaaccagcucaccuacgucgugaucgccauccugacgguggucgcggccaccauggccaacgagaugggcuuccuggagaagaccaagaaggaccucgggcugggcuccaucgccacccagcagccggagagcaacauccuggacaucgaccuccggcccgccuccgcguggacgcuguacgccguggccaccaccuucgugacccccaugcugcgccacagcaucgagaacagcuccgucaacgugagccucacggccaucgccaaccaggcgaccgugcugaugggccuggggaagggcuggccccucuccaagauggacaucggggucccgcugcuggccaucggcugcuacagccaggugaaccccaucacccucaccgccgcccugcugcuccugguggcgcacuacgccaucaucgggcccggccugcaggccaaggccacgcgggaggcccagaagcgcgcggccgccggcaucaugaagaaccccaccgucgacgggaucaccgugaucgaccucgacccgauccccuacgaccccaaguucgagaagcagcugggccaggugaugcugcucauccugugcgucacccaggugcugaugaugcggacgaccugggcccucugcgaggcccugacccuggcgaccgggcccaucuccacgcucugggagggcaacccggggcgcuucuggaacaccaccaucgccgugagcauggccaacaucuuccggggcuccuaccuggccggcgccgggcuccucuucagcaucaugaagaacaccacgaacacccgccgcggcaccgggaacaugggcgagacccugggcgagaaguggaagucccggcugaacgcgcucggcaagagcgaguuccagaucuacaagaaguccggcauccaggaggucgaccgcacgcuggccaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggcccggccacgaggagcccaucccgauguccacguacggguggaaccucgugcggcugcagagcggcgucgacguguucuucaucccgcccgagaagugcgacacccugcucugcgacaucggggaguccagccccaacccgaccguggaggcgggccgcacccugcggguccugaaccucguggagaacuggcugaacaacaacacgcaguucugcaucaaggugcugaaccccuacaugcccuccgucaucgagaagauggaggcccugcagcgcaaguacggcggggcccucgugcggaacccgcugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacccgcaacaucgggaucgaguccgagauccccaaccuggacaucaucggcaagcggaucgagaagaucaagcaggagcacgagacgagcuggcacuacgaccaggaccaccccuacaagaccugggcguaccacggcuccuacgagaccaagcagaccgggagcgccuccagcauggucaacggcguggugcgccugcucacgaagccgugggacguccugcccaccgugacccagauggccaugaccgacacgacccccuucgggcagcagcgcguguucaaggagaaggucgacacccggacccaggagcccaaggagggcacgaagaagcugaugaagaucaccgccgaguggcucuggaaggagcugggcaagaagaagaccccgcgcaugugcacccgggaggaguucacgcgcaaggugcgguccaacgccgcgcugggggccaucuucaccgacgagaacaaguggaaguccgcccgcgaggccguggaggacucccgguucugggagcucgucgacaaggagcgcaaccugcaccuggagggcaagugcgagaccugcguguacaacaugauggggaagcgggagaagaagcucggcgaguucgggaaggccaagggcagccgcgcgaucugguacauguggcugggcgcccgguuccuggaguucgaggcccucggguuccugaacgaggaccacugguucucccgcgagaacagccuguccggcgucgagggggagggccuccacaagcugggguacauccugcgggacgugagcaagaaggagggcggcgccauguacgcggacgacaccgccgggugggacacgcgcaucacccucgaggaccugaagaacgaggagauggugaccaaccacauggagggcgagcacaagaagcuggccgaggccaucuucaagcucaccuaccagaacaaggucgugcgggugcagcgccccacgccccgggggaccgucauggacaucaucagccgccgggaccagcgcggcuccggccaggugggcaccuacggccugaacaccuucacgaacauggaggcccagcugauccggcagauggagggggagggcguguucaagaacauccagcaccucaccgucaccgaggagguggcggugcagaacuggcuggcccgcgucgggcgcgagcggcugagccgcauggccaucuccggcgacgacugcguggugaagccccucgacgaccgguucgccaacgcccugaccgcgcugaacgacaugggcaagauccgcaaggacauccagcagugggagccgagcaagggguggaacgacuggacgcagguccccuucugcucccaccacuuccacgagcucaucaugaaggacggccgggugcuggugguccccugccgcaaccaggacgagcugaucgggcgggcccgcaucagccagggcgccggguggucccuccgggagaccgccugccugggcaagagcuacgcccagauguggucccugauguacuuccaccgccgggaccuccgccuggcggccaacgccaucugcagcgccgugcccucccacugggugccgaccagccggaccacgugguccauccacgccaagcacgaguggaugaccaccgaggacaugcugaccgucuggaaccgcguguggauccgggagaaccccuggauggaggacaagacccccguggagagcugggaggagauccccuaccucggcaagcgcgaggaccaguggugcgggucccugaucggccugacgagccgggcgaccugggccaagaacauccaggccgccaucaaccagguccgcucccucaucgggaacgaggaguacaccgacuacaugccgagcaugaagcgguuccgccgcgaggaggaggaggcgggcgugcugugguga

SEQ ID NO: 9530 - RNA, 9876 nt, Artificial Sequence
  derived and/or modified CDS sequence (opt1) from DENV-2__FJ859028__SS-prME
agcgcggggaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaagaacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccguggucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgucaccgccggccacggccagguggacaacuucagccugggcgugcugggcauggcccucuuccuggaggagaugcugcggacccgcgucgggacgaagcacgcgauccuccugguggccguguccuucgucacccugaucaccggcaacaugagcuucaaggaccucgggcgggugguggucauggugggcgccaccauggccgacgacaucgggaugggcgugacguaccuggcccugcucgcggccuucaagguccgccccaccuucgccgccggccugcugcuccggaagcugaccuccaaggagcugaugaugaccacgaucgggaucgugcuccugagccaguccaccauccccgagaccgugcuggagcucaccgacgcccuggcgcugggcaugaugguccucaagaucgugcgcaacauggagaaguaccagcuggccgucacgaucauggccauccugugcgugccgaacgccgugauccuccagaacgccuggaaggucagcugcaccauccuggcggugguguccgucagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcaugguguccauccuggccagcucccuccugaagaacgacauccccaugaccggcccccuggucgccgggggccuccugaccgugugcuacgugcugaccgggcgcagcgccgaccucgagcuggagcgggccacggacgucaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggugaagaagcagcgggccgggguccucugggacgugcccagcccgccgcccaugggcaaggcggagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcgcuggagcccggcaagaacccccgggccgugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucguccgggaggccaucaagcgcgggcugcggacccugauccucgcgccgacccgcgugguggccgccgagauggaggaggcccugcggggccugcccauccgcuaccagacccccgccauccgggcggagcacacggggcgcgagaucgucgaccucaugugccacgccaccuucaccaugcgccugcugagccccgugcgggugccgaacuacaaccucaucaucauggacgaggcccacuucaccgaccccgccuccaucgccgcgcgcggcuacaucagcacgcgggucgagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggugugguucgucccgagcaucaaggcggggaacgacaucgccgccugccugcggaagaacggcaagaaggugauccagcugucccgcaagaccuucgacagcgaguacgugaagacccggaccaacgacugggacuucgucgugacgaccgacaucuccgagaugggcgccaacuucaaggcggagcgcgugaucgacccccggcgcugcaugaagcccgucauccucaccgacggggaggagcgggugauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaaggucgacgccaucgacggcgaguaccggcugcgcggggaggcccgcaagaccuucguggaccucaugcggcgcggcgaccugcccguguggcuggccuacaaggucgccgcggaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccgugcugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucguccugcugauccccgagcccgagaagcagcggacgccccaggacaaccagcucacguacguggugaucgccauccugaccgucguggccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgucacgcccaugcugcggcacagcaucgagaacagcuccgugaacgugagccucaccgccaucgccaaccaggccaccguccugaugggccuggggaagggcuggccccucuccaagauggacaucggggugccgcugcuggcgaucggcugcuacagccaggugaaccccaucacccucacggccgcccugcugcuccuggucgcccacuacgcgaucaucgggcccggccugcaggccaaggccacccgcgaggcccagaagcgggccgcggccggcaucaugaagaaccccaccguggacgggaucaccgugaucgaccucgacccgauccccuacgaccccaaguucgagaagcagcugggccaggucaugcugcucauccugugcgugacccaggugcugaugaugcgcaccaccugggcccucugcgaggcccugacccuggccacggggcccaucuccacccucugggagggcaacccggggcgguucuggaacaccaccaucgcggucagcauggccaacaucuuccgcggcuccuaccuggccggcgccgggcuccucuucagcaucaugaagaacacgaccaacacccggcgcggcaccgggaacaugggcgagacgcugggcgagaaguggaagucccgccugaacgcccucgggaaguccgaguuccagaucuacaagaaguccggcauccaggagguggaccggacccuggcgaaggaggggaucaagcgcggcgagaccgaccaccacgccgugagccggggguccgccaagcugcgcugguucgucgagcggaacauggugacccccgagggcaagguggucgaccucggcugcgggcgcggcggguggagcuacuacugcggcgggcugaagaacgugcgggaggugaagggccugacgaagggcgggcccggccacgaggagcccaucccgauguccaccuacggguggaaccucguccgccugcagagcggcguggacguguucuucaucccgcccgagaagugcgacacccugcucugcgacaucggggaguccagccccaacccgaccgucgaggccggccggacgcugcgcgugcugaaccucguggagaacuggcugaacaacaacacccaguucugcaucaagguccugaaccccuacaugcccuccgugaucgagaagauggaggcgcugcagcggaaguacggcggggcccucgugcgcaacccgcugagccggaacagcacccacgagauguacugggucuccaacgccagcggcaacaucguguccagcgugaacaugaucucccgcaugcugaucaaccgguucaccaugcgccacaagaaggccaccuacgagcccgacgucgaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggugaacggcgugguccggcugcucaccaagccgugggacgugcugcccaccgugacccagauggccaugacggacaccacccccuucgggcagcagcgcgucuucaaggagaagguggacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggcgaucuucaccgacgagaacaaguggaaguccgcccgggaggccgucgaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgugagcaagaaggagggcggcgccauguacgccgacgacacggcggggugggacacccggaucacccucgaggaccugaagaacgaggagauggucaccaaccacauggagggcgagcacaagaagcuggccgaggccaucuucaagcucacguaccagaacaagguggugcgcguccagcggcccacgccccgggggaccgugauggacaucaucagccggcgcgaccagcggggcuccggccagguggggaccuacggccugaacacguucaccaacauggaggcccagcugauccgccagauggagggggagggcgucuucaagaacauccagcaccucaccgugaccgaggagguggccguccagaacuggcuggcgcggguggggcgcgagcgccugagccggauggccaucuccggcgacgacugcguggucaagccccucgacgaccgcuucgccaacgcccugacggcccugaacgacaugggcaagauccggaaggacauccagcagugggagccgagcaagggguggaacgacuggacccaggugcccuucugcucccaccacuuccacgagcucaucaugaaggacggccgcgugcuggucgugcccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccgugcccucccacugggucccgaccagccgcacgaccugguccauccacgccaagcacgaguggaugaccaccgaggacaugcugaccguguggaaccggguguggauccgcgagaaccccuggauggaggacaagacgcccgucgagagcugggaggagauccccuaccucggcaagcgggaggaccaguggugcgggucccugaucggccugaccagccgcgccaccugggcgaagaacauccagguggccaucaaccaggugcggucccucaucgggaacgaggaguacaccgacuacaugccgagcaugaagcgcuuccggcgcgaggaggaggaggccggcguccugugguga

SEQ ID NO: 9531 - RNA, 9876 nt, Artificial Sequence
  derived and/or modified CDS sequence (opt1) from DENV-2__FJ410200__SS-prME
agcgccgggaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucaacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccaugacggacgacaucgggaugggcgugaccuaccuggcccugcucgccgcguucaaggugcgccccaccuucgccgccggccugcugcuccggaagcugaccuccaaggagcugaugaugacgaccaucgggaucguccuccugagccaguccaccauccccgagaccgugcuggagcucacggacgcccuggcccugggcaugauggugcucaagaucguccgcaacauggagaaguaccagcuggcggugaccaucauggccauccugugcgucccgaacgccgugauccuccagaacgccuggaaggugagcugcaccauccuggccgucguguccgugagcccccugcuccugaccuccagccagcagaagacggacuggaucccccuggcgcucaccaucaaggggcugaaccccaccgccaucuuccugaccacgcucucccgcaccaacaagaagcggagcuggccgcugaacgaggccaucauggccgucggcaugguguccauccuggcgagcucccuccugaagaacgacauccccaugaccggcccccugguggccgggggccuccugaccgucugcuacgugcugacggggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacccucacgauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguacaaggaggggaccuuccacaccauguggcacgugacgcggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgcuccggcgccuacgugagcgccaucgcccagaccgagaaguccaucgagaacaaccccgagaucgaggacgacaucuuccggaagcgccggcugacgaucauggaccugcaccccggggcgggcaagaccaagcgcuaccuccccgccaucgugcgggaggccaucaagcgcgggcugcggacccugauccucgccccgacccgcgucguggcggccgagauggaggaggcccugcggggccugcccauccgcuaccagacgcccgccauccgggccgagcacaccgggcgcgagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggcgaggcggccgggaucuucaugaccgccacgccgcccggcagccgcgacccguucccccaguccaacgcccccaucaucgacgaggagcgggagauccccgagcgcagcuggaacuccgggcacgagugggucacggacuucaagggcaagaccgugugguucgugccgagcaucaaggccgggaacgacaucgcggccugccugcggaagaacggcaagaaggucauccagcugucccgcaagaccuucgacagcgaguacgugaagacccggacgaacgacugggacuucguggucaccaccgacaucuccgagaugggcgccaacuucaaggccgagcgcgugaucgacccccggcgcugcaugaagcccgugauccucaccgacggggaggagcgggucauccuggcgggccccaugccggugacgcacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgcgaucgacggcgaguaccggcugcgcggggaggcccgcaagaccuucgucgaccucaugcggcgcggcgaccugcccguguggcuggccuacaagguggccgccgaggggaucaacuacgcggaccggcgcuggugcuucgacggcaucaagaacaaccagauccucgaggagaacauggaggucgagaucuggaccaaggagggggagcggaagaagcugaagccgcgcuggcuggacgcccggaucuacuccgacccccucgcccugaaggaguucaaggaguucgccgccggccgcaagagccugacgcucaaccugaucaccgagaugggccggcugcccaccuucaugacccagaagacgcgcgacgcgcucgacaaccuggccgugcugcacaccgccgaggccgggggccgggcguacaaccacgcccucuccgagcugcccgagacccuggagacccuccugcugcucacgcugcuggccaccgucaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacguggucaucgccauccugaccgugguggccgccaccauggcgaacgagaugggcuuccuggagaagacgaagaaggaccucgggcugggcuccaucgccacccgccagccggagagcaacauccuggacaucgaccuccggcccgccuccgccuggacccuguacgccgucgcgaccacguucgugacccccaugcugcgccacagcaucgagaacagcuccgugaacgucagccucaccgccaucgccaaccaggccaccgugcugaugggccuggggaagggcuggccccucuccaagauggacaucggggugccgcugcuggccaucggcugcuacagccaggucaaccccaucacgcucaccgcggcccugcugcuccugguggcccacuacgccaucaucgggcccggccugcaggcgaaggccacccgggaggcccagaagcgcgccgccgcgggcaucaugaagaaccccaccguggacgggaucacggucaucgaccucgacccgauccccuacgaccccaaguucgagaagcagcugggccaggugaugcugcucgugcugugcgucacccaggugcugaugaugcggaccaccugggcccucugcgaggcccugacgcuggccaccgggcccaucuccacccucugggagggcaacccggggcgcuucuggaacaccacgaucgccgugagcauggcgaacaucuuccggggcuccuaccuggccggcgccgggcuccucuucagcaucaugaagaacaccaccaacacccgccgcggcacggggaacaugggcgagacccugggcgagaaguggaagucccggcugaacgcccucgggaaguccgaguuccagaucuacaagaaguccggcauccaggaggucgaccgcacccuggccaaggaggggaucaagcggggcgagaccgaccaccacgcggugagccgcggguccgccaagcugcggugguucguggagcgcaacauggucacgcccgagggcaaggugguggaccucggcugcgggcggggcggguggagcuacuacugcggcgggcugaagaacguccgcgaggugaagggccugaccaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgacgguggaggccggccgcacccugcggguccugaaccucguggagaacuggcugaacaacaacacccaguucugcaucaaggugcugaaccccuacaugcccuccgucaucgagaagauggaggcccugcagcgcaaguacggcggggcgcucgugcggaacccgcugagccgcaacagcacccacgagauguacuggguguccaacgccagcggcaacaucgucuccagcgugaacaugaucucccggaugcugaucaaccgcuucaccaugcggcacaagaaggccacguacgagcccgacguggaccucgggagcggcacccgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggucaacggcguggugcgccugcucaccaagccgugggacguccugcccaccgugacgcagauggcgaugaccgacaccacccccuucgggcagcagcgcguguucaaggagaaggucgacacgcggacccaggagcccaaggagggcaccaagaagcugaugaagaucaccgccgaguggcucuggaaggagcugggcaagaagaagacgccgcgccggugcacccgcgaggaguucacccggaaggugcgcuccaacgccgcccugggggccaucuucaccgacgagaacaaguggaaguccgcgcgggaggccguggaggacucccgcuucugggagcucgucgacaaggagcggaaccugcaccuggagggcaagugcgagacgugcguguacaacaugauggggaagcgcgagaagaagcucggcgaguucgggaaggccaagggcagccgggccaucugguacauguggcugggcgcccgcuuccuggaguucgaggcgcucggguuccugaacgaggaccacugguucucccgggagaacagccuguccggcgucgagggggagggccuccacaagcugggguacauccugcgcgacgugagcaagaaggagggcggcgccauguacgccgacgacaccgccgggugggacacccggaucacccucgaggaccugaagaacgaggagauggugacgaaccacauggagggcgagcacaagaagcuggcggaggccaucuucaagcucaccuaccagaacaaggucgugcgcgugcagcggcccacgccccgggggaccgucauggacaucaucagccggcgcgaccagcggggcuccggccagguggggacguacggccugaacaccuucaccaacauggaggcccagcugauccgccagauggagggggagggcguguucaagaacauccagcaccucaccgucacggaggagguggccgugaagaacuggcuggcccgcgucgggcgggagcgccugagccggauggcgaucuccggcgacgacugcguggugaagccccucgacgaccgcuucgccaacgcccugaccgcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcccggaucagccagggcgcgggguggucccuccgcgagaccgccugccugggcaagagcuacgcccagauguggucccugauguacuuccaccggcgcgaccuccggcuggccgccaacgcgaucugcagcgccgugcccucccacugggugccgacgagccgcaccaccugguccauccacgccaagcacgaguggaugaccaccgaggacaugcugacggucuggaaccggguguggauccgcgagaaccccuggauggaggacaagacccccguggagagcugggaggagauccccuaccucggcaagcgggaggaccaguggugcgggucccugaucggccugaccagccgcgccaccugggccaagaacauccaggcggccaucaaccagguccggucccucaucgggaacgaggaguacacggacuacaugccgagcaugaagcgcuuccgccgggaggaggaggaggccggcgugcugugguga

SEQ ID NO: 9532 - RNA, 9876 nt, Artificial Sequence
  derived and/or modified CDS sequence (opt1) from DENV-2__FJ410202__SS-prME
agcgccgggaugaucaucaugcugauccccaccgugauggccuuccaccucaccacccggaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcgucggcaaggcccuccaccagguguucggggccaucuacggcgcggccuucuccggcgugagcuggaccaugaagauccugaucggggucaucaucaccuggaucggcaugaacucccggagcaccucccugagcgugucccuggugcucgucgggaucgugacgcuguaccugggcgugaugguccaggccgacagcgggugcgugguguccuggaagaacaaggagcucaagugcggcagcggcaucuucaucaccgacaacguccacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggaggucgaggacuacggguucggcguguucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgucaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgucaccgccggccacggccagguggacaacuucagccugggcgugcugggcauggcccucuuccuggaggagaugcugcggacccgcgucgggacgaagcacgcgauccuccugguggccguguccuucgucacccugaucaccggcaacaugagcuucaaggaccucgggcgggugguggucauggugggcgccaccauggccgacgacaucgggaugggcgugacguaccuggcccugcucgcggccuucaagguccgccccaccuucgccgccggccugcugcuccggaagcugaccuccaaggagcugaugaugaccacgaucgggaucgugcuccugagccaguccaccauccccgagaccgugcuggagcucaccgacgcccuggcgcugggcaugaugguccucaagaucgugcgcaacauggagaaguaccagcuggccgucacgaucauggccauccugugcgugccgaacgccgugauccuccagaacgccuggaaggucagcugcaccauccuggcggugguguccgucagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcaugguguccauccuggccagcucccuccugaagaacgacauccccaugaccggcccccuggucgccgggggccuccugaccgugugcuacgugcugaccgggcgcagcgccgaccucgagcuggagcgggccacggacgucaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggugaagaagcagcgggccgggguccucugggacgugcccagcccgccgcccaugggcaaggcggagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcgcuggagcccggcaagaacccccgggccgugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucguccgggaggccaucaagcgcgggcugcggacccugauccucgcgccgacccgcgugguggccgccgagauggaggaggcccugcggggccugcccauccgcuaccagacccccgccauccgggcggagcacacggggcgcgagaucgucgaccucaugugccacgccaccuucaccaugcgccugcugagccccgugcgggugccgaacuacaaccucaucaucauggacgaggcccacuucaccgaccccgccuccaucgccgcgcgcggcuacaucagcacgcgggucgagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggugugguucgucccgagcaucaaggcggggaacgacaucgccgccugccugcggaagaacggcaagaaggugauccagcugucccgcaagaccuucgacagcgaguacgugaagacccggaccaacgacugggacuucgucgugacgaccgacaucuccgagaugggcgccaacuucaaggcggagcgcgugaucgacccccggcgcugcaugaagcccgucauccucaccgacggggaggagcgggugauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaaggucgacgccaucgacggcgaguaccggcugcgcggggaggcccgcaagaccuucguggaccucaugcggcgcggcgaccugcccguguggcuggccuacaaggucgccgcggaggggaucaacuacgccgaccggcgcuggugcuucgacggcaucaagaacaaccagauccucgaggagaacguggaggucgagguguggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccgugcugcacacggccgaggucgggggccgggcguacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucacguacgucgugaucgccauccugaccguggucgccgccaccauggcgaacgagaugggcuuccuggagaagaccaagaaggaccucgggcugggcuccaucgccacgcagcagccggagagcaacauccuggacaucgaccuccgccccgccuccgccuggacccuguacgccguggcgaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggccaucggcugcuacagccaggugaaccccaucacccucacggcggcccugcugcuccugguggcccacuacgccaucaucgggcccggccugcaggcgaaggccacccgcgaggcccagaagcgggccgccgcgggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgccgugagcauggcgaacaucuuccgcggcuccuaccuggccggcgccgggcuccucuucagcaucaugaagaacacgaccaacacccggcgcggcaccgggaacaugggcgagacgcugggcgagaaguggaagucccgccugaacgcccucgggaaguccgaguuccagaucuacaagcgguccggcauccaggaggucgaccgcacccuggccaaggaggggaucaagcggggcgagaccgaccaccacgcggugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugacgaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgaccguggaggccggccgcacgcugcggguccugaaccucguggagaacuggcugaacaacaacacccaguucugcaucaaggugcugaaccccuacaugcccuccgucaucgagaagauggaggcccugcagcgcaaguacggcggggcgcucgugcggaacccgcugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgccuccagcauggucaacggcguggugcgccugcucaccaagccgugggacguccugcccaccgugacccagauggcgaugacggacaccacccccuucgggcagcagcgcguguucaaggagaaggucgacacccggacgcaggagcccaaggagggcaccaagaagcugaugaagaucaccgccgaguggcucuggaaggagcugggcaagaagaagaccccgcgcaugugcacgcgggaggaguucacccgcaaggugcgguccaacgccgcccugggggccaucuucaccgacgagaacaaguggaaguccgcgcgcgaggccgucgaggacucccgguucugggagcucguggacaaggagcgcaaccugcaccuggagggcaagugcgagaccugcguguacaacaugauggggaagcgggagaagaagcucggcgaguucgggaaggccaagggcagccgcgccaucugguacauguggcugggcgcccgguuccuggaguucgaggcgcucggguuccugaacgaggaccacugguucucccgcgagaacagccuguccggcgucgagggggagggccuccacaagcugggguacauccugcgggacgugagcaagaaggagggcggcgccauguacgccgacgacacggccgggugggacacccgcaucacccucgaggaccugaagaacgaggagauggugaccaaccacauggagggcgagcacaagaagcuggcggaggccaucuucaagcucacguaccagaacaaggucgugcgggugcagcgccccacgccccgggggaccgucauggacaucaucagccgccgggaccagcgcggcuccggccagguggggaccuacggccugaacacguucaccaacauggaggcccagcugauccggcagauggagggggagggcguguucaagaacauccagcaccucaccgucaccgaggagguggccgugcagaacuggcuggcccgcgucgggcgcgagcggcugagccgcauggcgaucuccggcgacgacugcguggugaagccccucgacgaccgguucgccaacgcccugacggcccugaacgacaugggcaagauccgcaaggacauccagcagugggagccgagcaagggguggaacgacuggacccagguccccuucugcucccaccacuuccacgagcucaucaugaaggacggccgggugcuggugguccccugccgcaaccaggacgagcugaucgggcgggcccgcaucagccagggcgcgggguggucccuccgggagaccgccugccugggcaagagcuacgcccagauguggucccugauguacuuccaccgccgggaccuccgccuggccgccaacgcgaucugcagcgccgugcccucccacugggugccgaccagccggacgaccugguccauccacgccaagcacgaguggaugaccaccgaggacaugcugaccgucuggaaccgcguguggauccgggagaaccccuggauggaggacaagacgcccguggagagcugggaggagauccccuaccucggcaagcgcgaggaccaguggugcgggucccugaucggccugaccagccgggccaccugggccaagaacauccaggcggccaucaaccagguccgcucccucaucgggaacgaggaguacaucgacuacaugccgagcaugaagcgguuccgccgcgaggaggaggaggccggcgugcugugguga

SEQ ID NO: 9533 - RNA, 9876 nt, Artificial Sequence
  derived and/or modified CDS sequence (opt1) from DENV-2__FJ410208__SS-prME
agcgccgggaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccggcgggagaagcgcagcgucgcccuggugccccacguggggaugggccucgagacccggaccgagaccuggauguccagcgagggggccuggaagcacgcccagcggaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucaacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccaugacggacgacaucgggaugggcgugaccuaccuggcccugcucgccgcguucaaggugcgccccaccuucgccgccggccugcugcuccggaagcugaccuccaaggagcugaugaugacgaccaucgggaucguccuccugagccaguccaccauccccgagaccgugcuggagcucacggacgcccuggcccugggcaugauggugcucaagaucguccgcaacauggagaaguaccagcuggcggugaccaucauggccauccugugcgucccgaacgccgugauccuccagaacgccuggaaggugagcugcaccauccuggccgucguguccgugagcccccugcuccugaccuccagccagcagaagacggacuggaucccccuggcgcucaccaucaaggggcugaaccccaccgccaucuuccugaccacgcucucccgcaccaacaagaagcggagcuggccgcugaacgaggccaucauggccgucggcaugguguccauccuggcgagcucccuccugaagaacgacauccccaugaccggcccccugguggccgggggccuccugaccgucugcuacgugcugacggggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacccucacgauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguacaaggaggggaccuuccacaccauguggcacgugacgcggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgcuccggcgccuacgugagcgccaucgcccagaccgagaaguccaucgaggacaaccccgagaucgaggacgacaucuuccggaagcgccggcugacgaucauggaccugcaccccggggcgggcaagaccaagcgcuaccuccccgccaucgugcgggaggccaucaagcgcgggcugcggacccugauccucgccccgacccgcgucguggcggccgagauggaggaggcccugcggggccugcccauccgcuaccagacgcccgccauccgggccgagcacaccgggcgcgagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggcgaggcggccgggaucuucaugaccgccacgccgcccggcagccgcgacccguucccccaguccaacgcccccaucaucgacgaggagcgggagauccccgagcgcagcuggaacuccgggcacgagugggucacggacuucaagggcaagaccgugugguucgugccgagcaucaaggccgggaacgacaucgcggccugccugcggaagaacggcaagaaggucauccagcugucccgcaagaccuucgacagcgaguacgugaagacccggacgaacgacugggacuucguggucaccaccgacaucuccgagaugggcgccaacuucaaggccgagcgcgugaucgacccccggcgcugcaugaagcccgugauccucaccgacggggaggagcgggucauccuggcgggccccaugccggugacgcacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgcgaucgacggcgaguaccggcugcgcggggaggcccgcaagaccuucgucgaccucaugcggcgcggcgaccugcccguguggcuggccuacaagguggccgccgaggggaucaacuacgcggaccggcgcuggugcuucgacggcaucaagaacaaccagauccucgaggagaacauggaggucgagaucuggaccaaggagggggagcggaagaagcugaagccgcgcuggcuggacgcccggaucuacuccgacccccucgcccugaaggaguucaaggaguucgccgccggccgcaagagccugacgcucaaccugaucaccgagaugggccggcugcccaccuucaugacccagaagacgcgcgacgcgcucgacaaccuggccgugcugcacaccgccgaggccgggggccgggcguacaaccacgcccucuccgagcugcccgagacccuggagacccuccugcugcucacgcugcuggccaccgucaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacguggucaucgccauccugaccgugguggccgccaccauggcgaacgagaugggcuuccuggagaagacgaagaaggaccucgggcugggcuccaucgccacccgccagccggagagcaacauccuggacaucgaccuccggcccgccuccgccuggacccuguacgccgucgcgaccacguucgugacccccaugcugcgccacagcaucgagaacagcuccgugaacgucagccucaccgccaucgccaaccaggccaccgugcugaugggccuggggaagggcuggccccucuccaagauggacaucggggugccgcugcuggccaucggcugcuacagccaggucaaccccaucacgcucaccgcggcccugcugcuccugguggcccacuacgccaucaucgggcccggccugcaggcgaaggccacccgggaggcccagaagcgcgccgccgcgggcaucaugaagaaccccaccguggacgggaucacggucaucgaccucgacccgauccccuacgaccccaaguucgagaagcagcugggccaggugaugcugcucgugcugugcgucacccaggugcugaugaugcggaccaccugggcccucugcgaggcccugacgcuggccaccgggcccaucuccacccucugggagggcaacccggggcgcuucuggaacaccacgaucgccgugagcauggcgaacaucuuccggggcuccuaccuggccggcgccgggcuccucuucagcaucaugaagaacaccaccaacacccgccgcggcacggggaacaugaucgagacccugggcgagaaguggaagucccggcugaacgcccucggcaagagcgaguuccagaucuacaagaaguccgggauccaggaggucgaccgcacccuggccaaggagggcaucaagcgcggggagaccgaccaccacgcggugagccgcggcuccgccaagcugcggugguucguggagcgcaacauggucacgcccgaggggaaggugguggaccucggcugcggccgcggcggguggagcuacuacugcgggggccugaagaacguccgcgaggugaaggggcugaccaagggcggccccgggcacgaggagcccaucccgauguccaccuacggcuggaaccucgugcggcugcagagcggggucgacguguucuucaucccgcccgagaagugcgacacccugcucugcgacaucggcgaguccagccccaacccgacgguggaggccgggcgcacccugcggguccugaaccucguggagaacuggcugaacaacaacacccaguucugcaucaaggugcugaaccccuacaugcccuccgucaucgagaagauggaggcccugcagcgcaaguacggcggcgcgcucgugcggaacccgcugagccgcaacagcacccacgagauguacuggguguccaacgccagcgggaacaucgucuccagcgugaacaugaucucccggaugcugaucaaccgcuucaccaugcggcacaagaaggccacguacgagcccgacguggaccucggcagcgggacccgcaacaucggcaucgaguccgagauccccaaccuggacaucaucgggaagcggaucgagaagaucaagcaggagcacgagaccagcuggcacuacgaccaggaccaccccuacaagaccugggccuaccacggcuccuacgagacgaagcagaccggcagcgccuccagcauggucaacgggguggugcgccugcucaccaagccgugggacguccugcccaccgugacgcagauggcgaugaccgacaccacccccuucggccagcagcgcguguucaaggagaaggucgacacgcggacccaggagcccaaggaggggaccaagaagcugaugaagaucaccgccgaguggcucuggaaggagcugggcaagaagaagacgccgcgcaugugcacccgggaggaguucacccgcaaggugcgguccaacgccgcccugggcgccaucuucaccgacgagaacaaguggaaguccgcgcgcgaggccguggaggacucccgguucugggagcucgucgacaaggagcgcaaccugcaccuggaggggaagugcgagacgugcguguacaacaugaugggcaagcgggagaagaagcucggggaguucggcaaggccaaggggagccgcgccaucugguacauguggcugggcgcccgguuccuggaguucgaggcgcucggcuuccugaacgaggaccacugguucucccgcgagaacagccuguccggggucgagggcgaggggcuccacaagcugggcuacauccugcgggacgugagcaagaaggagggcggggccauguacgccgacgacaccgccggcugggacacccgcaucacccucgaggaccugaagaacgaggagauggugacgaaccacauggagggggagcacaagaagcuggcggaggccaucuucaagcucaccuaccagaacaaggucgugcgggugcagcgccccacgccccggggcaccgucauggacaucaucagccgccgggaccagcgcggguccggccagguggggacguacggccugaacaccuucaccaacauggaggcccagcugauccggcagauggagggcgaggggguguucaagaacauccagcaccucaccgucacggaggagguggccgugaagaacuggcuggcccgcgucggccgcgagcggcugagccgcauggcgaucuccggggacgacugcguggugaagccccucgacgaccgguucgccaacgcccugaccgcccugaacgacaugggcaagauccgcaaggacauccagcagugggagccgagcaagggcuggaacgacuggacccagguccccuucugcucccaccacuuccacgagcucaucaugaaggacgggcgggugcuggugguccccugccgcaaccaggacgagcugaucggccgggcccgcaucagccagggggcgggcuggucccuccgggagaccgccugccugggcaagagcuacgcccagauguggucccugauguacuuccaccgccgggaccuccgccuggccgccaacgcgaucugcagcgccgugcccucccacugggugccgacgagccggaccaccugguccauccacgccaagcacgaguggaugaccaccgaggacaugcugacggucuggaaccgcguguggauccgggagaaccccuggauggaggacaagacccccguggagagcugggaggagauccccuaccucggcaagcgcgaggaccaguggugcggcucccugaucgggcugaccagccgggccaccugggccaagaacauccaggcggccaucaaccagguccgcucccucaucggcaacgaggaguacacggacuacaugccgagcaugaagcgguuccgccgcgaggaggaggaggccggggugcugugguga

SEQ ID NO: 9534 - RNA, 9876 nt, Artificial Sequence
  derived and/or modified CDS sequence (opt1) from DENV-2__FJ461305__SS-prME
agcgcggggaugaucaucaugcugauccccaccgugauggccuuccaccucaccacccggaacggggagccccacaugaucgugggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcagaucgacaacuucagccugggcguccugggcauggcccucuuccuggaggagaugcugaagacccggguggggacgaagcacgcgauccuccugguggccgucuccuucgugacccugaucaccggcaacaugagcuucaaggaccucgggcgcguggucgugauggugggcgccaccauggccgacgacaucgggaugggcgucacguaccuggcccugcucgcggccuucaaggugcggcccaccuucgccgccggccugcugcuccgcaagcugaccuccaaggagcugaugaugaccacgaucgggaucgugcuccugagccaguccaccauccccgagaccguccuggagcucaccgacgcccuggcgcugggcaugauggugcucaagaucgugcggaacauggagaaguaccagcuggccgucacgaucauggccauccugugcgugccgaacgccgucauccuccagaacgccuggaaggugagcugcaccauccuggcgguggucuccgugagcccccugcuccugaccuccagccagcagaagaccgacuggaucccccuggcccucacgaucaaggggcugaaccccaccgccaucuuccugaccacccucucccgcacgaacaagaagcgcagcuggccgcugaacgaggccaucauggcggugggcauggucuccauccuggccagcucccuccugaagaacgacauccccaugaccggcccccugguggccgggggccuccugaccgugugcuacguccugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgugaucuccggccuguucccgaucagcauccccaucaccgccgccgccugguaccugugggaggucaagaagcagcgcgccggggugcucugggacgugcccagcccgccgcccaugggcaaggcggagcuggaggacggggccuaccggaucaagcagaagggcauccugggguacagccagaucggcgccggcgucuacaaggaggggaccuuccacaccauguggcacgugacccgcggcgccgugcucaugcacaaggggaagcggaucgagcccuccugggccgacgucaagaaggaccugaucagcuacggcgggggcuggaagcuggagggcgaguggaaggagggggaggagguccaggugcucgcgcuggagcccggcaagaacccccgcgccguccagacgaagcccgggcuguucaagaccaacaccggcaccaucggggccgugucccucgacuucagccccggcacguccggcagccccaucaucgacaagaaggggaagguggucggccuguacgggaacggcguggugacccgguccggcgccuacgucagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccggguggucgccgccgagauggaggaggcccugcgcggccugcccauccgguaccagacccccgccauccgcgcggagcacacggggcgggagaucguggaccucaugugccacgccaccuucaccaugcgccugcugagccccgugcgcgucccgaacuacaaccucaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggugaccgacuucaagggcaagacggucugguucgugccgagcaucaaggcggggaacgacaucgccgccugccugcgcaagaacggcaagaaggugauccagcugucccggaagaccuucgacagcgaguacgucaagacccgcaccaacgacugggacuucguggugacgaccgacaucuccgagaugggcgccaacuucaaggcggagcgggucaucgacccccgccggugcaugaagcccgugauccucaccgacggggaggagcgcgugauccuggccggccccaugccggucacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaagguggacgccaucgacggcgaguaccgccugcgcggggaggcccgcaagaccuucguggaccucaugcgccggggcgaccugcccgucuggcuggccuacaagguggccgcggaggggaucaacuacgccgaccgccgguggugcuucgacggcaucaagaacaaccagauccucgaggagaacguggaggucgagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccgugcugcacacggccgaggccggcgggcgcgccuacaaccacgcccucuccgagcugcccgagacccuggagacccuccugcugcucacccugcuggccacggucaccgggggcaucuuccucuuccugaugagcggccgggggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucacguacguggucaucgccauccugaccgugguggccgcgaccauggccaacgagaugggcuuccuggagaagaccaagaaggaccucgggcugggcuccaucgccacgcagcagccggagagcaacauccuggacaucgaccuccggcccgccuccgccuggacccuguacgcggucgccaccaccuucgugacgcccaugcugcgccacagcaucgagaacagcuccgugaacgucagccucaccgccaucgccaaccaggccaccgugcugaugggccuggggaagggcuggccccucuccaagauggacaucggggugccgcugcuggcgaucggcugcuacagccaggucaaccccaucacccucacggccgcccugcugcuccugguggcccacuacgcgaucaucgggcccggccugcaggccaaggccacccgggaggcccagaagcgcgccgcggccggcaucaugaagaaccccaccguggacgggaucaccgucaucgaccucgacccgauccccuacgaccccaaguucgagaagcagcugggccaggugaugcugcucauccugugcgugacgcagguccugaugaugcggaccaccugggcccucugcgaggcccugacccuggccacggggcccaucuccacccucugggagggcaacccggggcgcuucuggaacaccaccaucgcggugagcauggccaacaucuuccggggcuccuaccuggccggcgccgggcuccucuucagcaucaugaagaacacgaccaacacccgccggggcaccgggaacaugggcgagacgcugggcgagaaguggaagucccgccugaacgcccucggcaagagcgaguuccagaucuacaagaaguccggcauccaggagguggaccgcacccuggcgaaggaggggaucaagcggggcgagaccgaccaccacgccgucagccgcggguccgccaagcugcggugguucguggagcgcaacauggugacccccgagggcaaggucguggaccucggcugcgggcggggcggguggagcuacuacugcggcgggcugaagaacgugcgcgaggucaagggccugacgaagggcgggcccggccacgaggagcccaucccgauguccaccuacggguggaaccucgugcggcugcagagcggcguggacgucuucuucaucccgcccgagaagugcgacacccugcucugcgacaucggggaguccagccccaacccgaccguggaggccggccgcacgcugcgggugcugaaccucgucgagaacuggcugaacaacaacacccaguucugcaucaaggugcugaaccccuacaugcccuccgugaucgagaagauggaggcgcugcagcgcaaguacggcggggcccucguccggaacccgcugagccgcaacagcacccacgagauguacuggguguccaacgccagcggcaacaucguguccagcgucaacaugaucucccggaugcugaucaaccgcuucaccaugcggcacaagcgcgccaccuacgagcccgacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggugaacggcgucgugcggcugcucaccaagccgugggacgugcugcccaccgucacccagauggccaugacggacaccacccccuucgggcagcagcgcguguucaaggagaagguggacacccgcacgcaggagcccaaggagggcaccaagaagcugaugaagaucaccgccgaguggcucuggaaggagcugggcaagaagaagaccccgcggaugugcacgcgcgaggaguucacccggaagguccgcuccaacgccgcccugggggcgaucuucaccgacgagaacaaguggaaguccgcccgggaggccguggaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgucagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggugguccgcgugcagcggcccacgccccgggggaccgugauggacaucaucagccggcgcgaccagcggggcuccgggcaggucggcaccuacggccugaacacguucaccaacauggaggcccagcugauccgccagauggagggggagggcguguucaagaacauccagcaccucaccgugaccgaggaggucgccgugcagaacuggcuggcgcggguggggcgcgagcgccugagccggauggccaucuccggcgacgacugcgucgugaagccccucgacgaccgcuucgccaacgcccugacggcccugaacgacaugggcaagauccggaaggacauccagcagugggagccgagcaagggguggaacgacuggacccaggugcccuucugcucccaccacuuccacgagcucaucaugaaggacggccgcguccugguggugcccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccguccccucccacugggugccgaccagccgcacgaccugguccauccacgccaagcacgaguggaugaccaccgaggacaugcugaccguguggaaccgggucuggauccgcgagaaccccuggauggaggacaagacgcccguggagagcugggaggagauccccuaccucggcaagcgggaggaccaguggugcgggucccugaucggccugaccagccgcgccaccugggcgaagaacauccaggccgccaucaaccaggugcggucccucaucgggaacgaggaguacaccgacuacaugccgagcaugaagcgcuuccggcgcgaggaggaggaggccggcguccugugguga

SEQ ID NO: 9535 - RNA, 9876 nt, Artificial Sequence
  derived and/or modified CDS sequence (opt1) from DENV-2__FJ410215__SS-prME
agcgccggcaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccgccauggccgacgacaucgggaugggcgugaccuaccuggcgcugcucgccgccuucaaggugcgccccacguucgccgccggccugcugcuccggaagcugaccuccaaggagcugaugaugaccaccaucgggaucguccuccugagccaguccacgauccccgagaccgugcuggagcucaccgacgcgcuggcccugggcaugauggugcucaagaucguccgcaacauggagaaguaccagcuggccgugaccaucauggccauccugugcgucccgaacgccgugauccuccagaacgcguggaaggugagcugcacgauccuggccgucguguccgugagcccccugcuccugaccuccagccagcagaagaccgacuggaucccccuggcccucaccaucaaggggcugaaccccacggccaucuuccugaccacccucucccgcaccaacaagaagcggagcuggccgcugaacgaggcgaucauggccgucggcaugguguccauccuggccagcucccuccugaagaacgacauccccaugacgggcccccugguggccgggggccuccugaccgucugcuacgugcugaccgggcgcagcgccgaccucgagcuggagcgggcgaccgacgugaagugggaggaccaggccgagaucuccggcagcagccccauccuguccaucacgaucagcgaggacggguccaugagcaucaagaacgaggaggaggagcagacccucaccauccugauccgcaccggccugcucgucaucuccggccuguucccgaucagcauccccaucacggccgccgccugguaccugugggaggugaagaagcagcgggcgggggugcucugggacguccccagcccgccgcccaugggcaaggccgagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggcggacgugaagaaggaccugaucagcuacggcgggggcuggaagcuggagggcgaguggaaggagggggaggaggugcagguccucgcccuggagcccggcaagaacccccgggccgugcagaccaagcccgggcuguucaagacgaacaccggcaccaucggggccgugucccucgacuucagccccggcaccuccggcagccccaucaucgacaagaaggggaaggucgugggccuguacgggaacggcguggucacgcgcuccggcgccuacgugagcgcgaucgcccagaccgagaaguccaucgaggacaaccccgagaucgaggacgacaucuuccggaagcgccggcugaccaucauggaccugcaccccggggccggcaagaccaagcgcuaccuccccgccaucgugcgggaggcgaucaagcgcgggcugcggacgcugauccucgccccgacccgcgucguggccgccgagauggaggaggcccugcggggccugcccauccgcuaccagacccccgcgauccgggccgagcacaccgggcgcgagaucguggaccucaugugccacgccacguucaccaugcgccugcugagccccguccgggugccgaacuacaaccucaucaucauggacgaggcccacuucaccgaccccgccuccaucgcggcccgcggcuacaucagcacccggguggagaugggcgaggccgccgggaucuucaugacggccacgccgcccggcagccgcgacccguucccccaguccaacgcgcccaucaucgacgaggagcgggagauccccgagcgcagcuggaacuccgggcacgagugggucaccgacuucaagggcaagaccgugugguucgugccgagcaucaaggccgggaacgacaucgccgccugccugcggaagaacggcaagaaggucauccagcugucccgcaagacguucgacagcgaguacgugaagacccggaccaacgacugggacuucguggucaccacggacaucuccgagaugggcgcgaacuucaaggccgagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcgcacuggaaggaggccaagaugcuccuggacaacaucaacacccccgagggcaucaucccgagcauguucgagcccgagcgcgagaagguggacgccaucgacggcgaguaccggcugcgcggggaggcccgcaagacguucgucgaccucaugcggcgcggcgaccugcccguguggcuggccuacaagguggcggccgaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgcggccggccgcaagagccugacccucaaccugaucaccgagaugggccggcugcccacguucaugacccagaagacccgcgacgcccucgacaaccuggccguccugcacaccgcggaggccgggggccgggccuacaaccacgcccucuccgagcugcccgagacgcuggagacccuccugcugcucacccugcuggccaccgugaccggcgggaucuuccucuuccugaugagcgggcgcgggaucggcaagaugacccuggggaugugcugcaucaucaccgcguccauccuccugugguacgcccagauccagccgcacuggaucgccgccagcaucauccuggaguucuuccucaucgugcugcugauccccgagcccgagaagcagcggacgccccaggacaaccagcucaccuacgucgugaucgccauccugacgguggucgcggccaccauggccaacgagaugggcuuccuggagaagaccaagaaggacuucgggcucggcuccaucgccacccagcagccggagagcaacauccuggacaucgaccugcgccccgccuccgcguggacgcucuacgccguggccaccaccuucgugacccccaugcugcggcacagcaucgagaacagcuccgucaacgugagccugacggccaucgccaaccaggcgaccgugcucaugggccuggggaagggcuggccccuguccaagauggacaucggggucccgcuccuggccaucggcugcuacagccaggugaaccccaucacccugaccgccgcccuccugcugcucguggcgcacuacgccaucaucgggcccggccugcaggccaaggccacgcgcgaggcccagaagcgggcggccgccggcaucaugaagaaccccaccgucgacgggaucaccgugaucgaccuggacccgauccccuacgaccccaaguucgagaagcagcucggccaggugaugcugcugauccucugcgucacccaggugcugaugaugcgcacgaccugggcccugugcgaggcccucacccuggcgaccgggcccaucuccacgcugugggagggcaacccggggcgguucuggaacaccaccaucgccgugagcauggccaacaucuuccgcggcuccuaccucgccggcgccgggcugcuguucagcaucaugaagaacaccacgaacacccggcgcggcaccgggaacaucggcgagacccucggcgagaaguggaagucccgccugaacgcgcuggggaaguccgaguuccagacguacaagaaguccggcauccaggaggucgaccggacccucgccaaggaggggaucaagcgcggcgagaccgaccaccacgccgugagccggggguccgccaagcugcgcugguucguggagcggaacauggucacccccgagggcaaggugguggaccugggcugcgggcgcggcggguggagcuacuacugcggcgggcucaagaacguccgggaggugaagggccugacgaagggcgggcccggccacgaggagcccaucccgauguccaccuacggguggaaccuggugcgccuccagagcggcgucgacguguucuucaucccgcccgagaagugcgacacccugcugugcgacaucggggaguccagccccaacccgaccguggaggcgggccggacgcuccgcguccugaaccugguggagaacuggcucaacaacaacacccaguucugcaucaaggugcugaaccccuacaugcccuccgucaucgagaagauggaggcccugcagcggaaguacggcggggcccuggugcgcaacccgcucagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccuggggagcggcacgcggaacaucgggaucgaguccgagauccccaaccucgacaucaucggcaagcgcaucgagaagaucaagcaggagcacgagaccagcuggcacuacgaccaggaccaccccuacaagaccugggcguaccacggcuccuacgagaccaagcagacggggagcgccuccagcauggucaacggcguggugcggcugcugaccaagccgugggacguccuccccaccgugacccagauggccaugacggacaccacccccuucgggcagcagcgcguguucaaggagaaggucgacacccgcacgcaggagcccaaggagggcaccaagaagcugaugaagaucaccgccgaguggcuguggaaggagcucggcaagaagaagaccccgcggaugugcacgcgcgaggaguucacccggaaggugcgcuccaacgccgcgcugggggccaucuucaccgacgagaacaaguggaaguccgcccgggaggccguggaggacucccgcuucugggagcuggucgacaaggagcggaaccuccaccuggagggcaagugcgagaccugcguguacaacaugauggggaagcgcgagaagaagcugggcgaguucgggaaggccaagggcagccgggcgaucugguacauguggcucggcgcccgcuuccuggaguucgaggcccugggguuccucaacgaggaccacugguucucccgggagaacagccuguccggcgucgagggggagggccugcacaagcucggguacauccugcgcgacgugagcaagaaggagggcggcgccauguacgcggacgacacggccgggugggacacccggaucacccuggaggaccucaagaacgaggagauggugaccaaccacauggagggcgagcacaagaagcuggccgaggccaucuucaagcugacguaccagaacaaggucgugcgcgugcagcggcccacgccccgggggaccgucauggacaucaucagccggcgcgaccagcggggcuccggccagguggggaccuacggccucaacacguucaccaacauggaggcccagcugauccgccagauggagggggagggcguguucaagaacauccagcaccugaccgucaccgaggagguggcggugcagaacuggcucgcccgggucgggcgcgagcgccugagccggauggccaucuccggcgacgacugcguggugaagccccuggacgaccgcuucgccaacgcccucacggcgcugaacgacaugggcaagauccggaaggacauccagcagugggagccgagcaagggguggaacgacuggacccagguccccuucugcucccaccacuuccacgagcugaucaugaaggacggccgcgugcucgugguccccugccggaaccaggacgagcugaucgggcgcgcccggaucagccagggcgccggguggucccugcgcgagaccgccugccucggcaagagcuacgcccagauguggucccugauguacuuccaccggcgcgaccugcggcucgcggccaacgccaucugcagcgccgugcccucccacugggugccgaccagccgcacgaccugguccauccacgccaagcacgaguggaugaccaccgaggacaugcugaccgucuggaaccggguguggauccgcgagaaccccuggauggaggacaagacgcccguggagagcugggaggagauccccuaccugggcaagcgggaggaccaguggugcgggucccucaucggccugaccagccgcgcgaccugggccaagaacauccaggccgccaucaaccagguccggucccugaucgggaacgaggaguacaccgacuacaugccgagcaugaagcgcuuccggcgcgaggaggaggaggcgggcgugcucugguga

SEQ ID NO: 9536 - RNA, 9876 nt, Artificial Sequence
  derived and/or modified CDS sequence (opt1) from DENV-2__FJ461309__SS-prME
agcgcggggaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugaagacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccggaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcgcagcuggccgcugaacgaggccaucauggcggucggcaugguguccauccuggccagcucccuccugaagaacgacauccccaugaccggcccccugguggccgggggccuccugaccgucugcuacgugcugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgucaucuccggccuguucccgaucagcauccccaucaccgccgccgccugguaccugugggaggugaagaagcagcgcgccggggugcucugggacguccccagcccgccgcccaugggcaaggcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccgggucguggccgccgagauggaggaggcccugcgcggccugcccauccgguaccagacccccgccauccgcgcggagcacacggggcgggagaucguggaccucaugugccacgccaccuucaccaugcgccugcugagccccguccgcgugccgaacuacaaccucaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagacggugugguucgugccgagcaucaaggcggggaacgacaucgccgccugccugcgcaagaacggcaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccucaccgacggggaggagcgcgucauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaagguggacgccaucgacggcgaguaccgccugcgcggggaggcccgcaagaccuucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccguccugcacacggccgaggccggcgggcgcgccuacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccggcccgccuccgccuggacccuguacgcgguggccaccaccuucgugacgcccaugcugcgccacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgggaggcccagaagcgcgccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacggggcccaucuccacccucugggagggcaacccggggcgcuucuggaacaccaccaucgcggugagcauggccaacaucuuccggggcuccuaccuggccggcgccgggcuccucuucagcaucaugaagaacacgaccaacacccgccggggcaccgggaacaugggcgagacgcugggcgagaaguggaagucccgccugaacgcccucggcaagagcgaguuccagaucuacaagaaguccggcauccaggaggucgaccgcacccuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugacgaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgaccguggaggccggccgcacgcugcggguccugaaccucguggagaacuggcugaacaacaacacccaguucugcaucaaggugcugaaccccuacaugcccuccgucaucgagaagauggaggcgcugcagcgcaaguacggcggggcccucgugcggaacccgcugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgcguccagcauggucaacggcguggugcgccugcucaccaagccgugggacguccugcccaccgugacccagauggccaugacggacaccacccccuucgggcagcagcggguguucaaggagaaggucgacacccgcacgcaggagcccaaggagggcaccaagaagcugaugaagaucaccgccgaguggcucuggaaggagcugggcaagaagaagaccccgcgcaugugcacgcgggaggaguucacccgcaaggugcgguccaacgccgcccugggggcgaucuucaccgacgagaacaaguggaaguccgcccgcgaggccguggaggacggccgguucugggagcucgucgacaaggagcgcaaccugcaccuggaggggaagugcgagaccugcguguacaacaugaugggcaagcgggagaagaagcucggggaguucggcaaggccaagggcucccgcgccaucugguacauguggcugggggcgcgguuccuggaguucgaggcccucggcuuccugaacgaggaccacugguucagccgcgagaacucccugagcggggucgagggcgaggggcuccacaagcugggcuacauccugcgggacguguccaagaaggagggcggggccauguacgccgacgacacggcgggcugggacacccgcaucacccucgaggaccugaagaacgaggagauggugaccaaccacauggagggggagcacaagaagcuggccgaggccaucuucaagcucacguaccagaacaaggucgugcgggugcagcgccccacgccccggggcaccgucauggacaucaucagccgccgggaccagcgcgggagcggccaggugggcaccuacgggcugaacacguucaccaacauggaggcccagcugauccggcagauggagggcgaggggguguucaagaacauccagcaccucaccgucaccgaggagguggccgugcagaacuggcuggcgcgcgucggccgggagcgccugucccgcauggccaucagcggcgacgacugcguggugaagccccucgacgaccgguucgccaacgcccugacggcccugaacgacauggggaagauccgcaaggacauccagcagugggagccguccaagggcuggaacgacuggacccagguccccuucugcagccaccacuuccacgagcucaucaugaaggacgggcgggugcuggugguccccugccgcaaccaggacgagcugaucggccgggcgcgcaucucccagggggccggcuggagccuccgggagaccgccugccugggcaaguccuacgcccagauguggagccugauguacuuccaccgccgggaccuccgccuggccgcgaacgccaucugcuccgccgugcccagccacugggugccgaccucccggacgaccuggagcauccacgccaagcacgaguggaugaccaccgaggacaugcugaccgucuggaaccgcguguggauccgggagaaccccuggauggaggacaagacgcccguggaguccugggaggagauccccuaccucgggaagcgcgaggaccaguggugcggcagccugaucgggcugaccucccgggccaccugggcgaagaacauccaggccgccaucaaccagguccgcagccucaucggcaacgaggaguacaccgacuacaugccguccaugaagcgguuccgccgggaggaggaggaggccggggugcugugguga

SEQ ID NO: 9537 - RNA, 9876 nt, Artificial Sequence
  derived and/or modified CDS sequence (opt1) from DENV-2__FJ461311__SS-prME
agcgccgggaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucaacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccaugacggacgacaucgggaugggcgugaccuaccuggcccugcucgccgcguucaaggugcgccccaccuucgccgccggccugcugcuccggaagcugaccuccaaggagcugaugaugacgaccaucgggaucguccuccugagccaguccaccauccccgagaccgugcuggagcucacggacgcccuggcccugggcaugauggugcucaagaucguccgcaacauggagaaguaccagcuggcggugaccaucauggccauccugugcgucccgaacgccgugauccuccagaacgccuggaaggugagcugcaccauccuggccgucguguccgugagcccccugcuccugaccuccagccagcagaagacggacuggaucccccuggcgcucaccaucaaggggcugaaccccaccgccaucuuccugaccacgcucucccgcaccaacaagaagcggagcuggccgcugaacgaggccaucauggccgucggcaugguguccauccuggcgagcucccuccugaagaacgacauccccaugaccggcccccugguggccgggggccuccugaccgucugcuacgugcugacggggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacccucacgauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguacaaggaggggaccuuccacaccauguggcacgugacgcggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgcuccggcgccuacgugagcgccaucgcccagaccgagaaguccaucgaggacaaccccgagaucgaggacgacaucuuccggaagcgccggcugacgaucauggaccugcaccccggggcgggcaagaccaagcgcuaccuccccgccaucgugcgggaggccaucaagcgcgggcugcggacccugauccucgccccgacccgcgucguggcggccgagauggaggaggcccugcggggccugcccauccgcuaccagacgcccgccauccgggccgagcacaccgggcgcgagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggcgaggcggccgggaucuucaugaccgccacgccgcccggcagccgcgacccguucccccaguccaacgcccccaucaucgacgaggagcgggagauccccgagcgcagcuggaacuccgggcacgagugggucacggacuucaagggcaagaccgugugguucgugccgagcaucaaggccgggaacgacaucgcggccugccugcggaagaacggcaagaaggucauccagcugucccgcaagaccuucgacagcgaguacgugaagacccggacgaacgacugggacuucguggucaccaccgacaucuccgagaugggcgccaacuucaaggccgagcgcgugaucgacccccggcgcugcaugaagcccgugauccucaccgacggggaggagcgggucauccuggcgggccccaugccggugacgcacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgcgaucgacggcgaguaccggcugcgcggggaggcccgcaagaccuucgucgaccucaugcggcgcggcgaccugcccguguggcuggccuacaagguggccgccgaggggaucaacuacgcggaccggcgcuggugcuucgacggcaucaagaacaaccagauccucgaggagaacauggaggucgagaucuggaccaaggagggggagcggaagaagcugaagccgcgcuggcuggacgcccggaucuacuccgacccccucgcccugaaggaguucaaggaguucgccgccggccgcaagagccugacgcucaaccugaucaccgagaugggccggcugcccaccuucaugacccagaagacgcgcgacgcgcucgacaaccuggccgugcugcacaccgccgaggccgggggccgggcguacaaccacgcccucuccgagcugcccgagacccuggagacccuccugcugcucacgcugcuggccaccgucaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacguggucaucgccauccugaccgugguggccgccaccauggcgaacgagaugggcuuccuggagaagacgaagaaggaccucgggcugggcuccaucgccacccgccagccggagagcaacauccuggacaucgaccuccggcccgccuccgccuggacccuguacgccgucgcgaccacguucgugacccccaugcugcgccacagcaucgagaacagcuccgugaacgucagccucaccgccaucgccaaccaggccaccgugcugaugggccuggggaagggcuggccccucuccaagauggacaucggggugccgcugcuggccaucggcugcuacagccaggucaaccccaucacgcucaccgcggcccugcugcuccugguggcccacuacgccaucaucgggcccggccugcaggcgaaggccacccgggaggcccagaagcgcgccgccgcgggcaucaugaagaaccccaccguggacgggaucacggucaucgaccucgacccgauccccuacgaccccaaguucgagaagcagcugggccaggugaugcugcucgugcugugcgucacccaggugcugaugaugcggaccaccugggcccucugcgaggcccugacgcuggccaccgggcccaucuccacccucugggagggcaacccggggcgcuucuggaacaccacgaucgccgugagcauggcgaacaucuuccggggcuccuaccuggccggcgccgggcuccucuucagcaucaugaagaacaccaccaacacccgccgcggcacggggaacaugggcgagacccugggcgagaaguggaagucccagcugaacgcccucgggaaguccgaguuccagaucuacaagaaguccggcauccaggaggucgaccggacccuggccaaggaggggaucaagcgcggcgagaccgaccaccacgcggugagccggggguccgccaagcugcgcugguucguggagcggaacauggucacgcccgagggcaaggugguggaccucggcugcgggcgcggcggguggagcuacuacugcggcgggcugaagaacguccgggaggugaagggccugaccaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgacgguggaggccggccggacccugcgcguccugaaccucguggagaacuggcugaacaacaacacccaguucugcaucaaggugcugaaccccuacaugcccuccgucaucgagaagauggaggcccugcagcggaaguacggcggggcgcucgugcgcaacccgcugagccggaacagcacccacgagauguacuggguguccaacgccagcggcaacaucgucuccagcgugaacaugaucucccgcaugcugaucaaccgguucaccaugcgccacaagaaggccacguacgagcccgacguggaccucgggagcggcacccggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggucaacggcguggugcggcugcucaccaagccgugggacguccugcccaccgugacgcagauggcgaugaccgacaccacccccuucgggcagcagcgcguguucaaggagaaggucgacacgcgcacccaggagcccaaggagggcaccaagaagcugaugaagaucaccgccgaguggcucuggaaggagcugggcaagaagaagacgccgcggaugugcacccgcgaggaguucacccggaaggugcgcuccaacgccgcccugggggccaucuucaccgacgagaacaaguggaaguccgcgcgggaggccguggaggacucccgcuucugggagcucgucgacaaggagcggaaccugcaccuggagggcaagugcgagacgugcguguacaacaugauggggaagcgcgagaagaagcucggcgaguucgggaaggccaagggcagccgggccaucugguacauguggcugggcgcccgcuuccuggaguucgaggcgcucggguuccugaacgaggaccacugguucucccgggagaacagccuguccggcgucgagggggagggccuccacaagcugggguacauccugcgcgacgugagcaagaaggagggcggcgccauguacgccgacgacaccgccgggugggacacccggaucacccucgaggaccugaagaacgaggagauggugacgaaccacauggagggcgagcacaagaagcuggcggaggccaucuucaagcucaccuaccagaacaaggucgugcgcgugcagcggcccacgccccgggggaccgucauggacaucaucagccggcgcgaccagcggggcuccggccagguggggacguacggccugaacaccuucaccaacauggaggcccagcugauccgccagauggagggggagggcguguucaagaacauccagcaccucaccgucacggaggagguggccgugaagaacuggcuggcccgggucgggcgcgagcgccugagccggauggcgaucuccggcgacgacugcguggugaagccccucgacgaccgcuucgccaacgcccugaccgcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcccggaucagccagggcgcgggguggucccuccgcgagaccgccugccugggcaagagcuacgcccagauguggucccugauguacuuccaccggcgcgaccuccggcuggccgccaacgcgaucugcagcgccgugcccucccacugggugccgacgagccgcaccaccugguccauccacgccaagcacgaguggaugaccaccgaggacaugcugacggucuggaaccggguguggauccgcgagaaccccuggauggaggacaagacccccguggagagcugggaggagauccccuaccucggcaagcgggaggaccaguggugcgggucccugaucggccugaccagccgcgccaccugggccaagaacauccaggcggccaucaaccagguccggucccucaucgggaacgaggaguacacggacuacaugccgagcaugaagcgcuuccggcgcgaggaggaggaggccggcgugcugugguga

SEQ ID NO: 9538 - RNA, 9876 nt, Artificial Sequence
  derived and/or modified CDS sequence (opt1) from DENV-2__FJ410217__SS-prME
agcgccgggaugaucaucaugcugauccccaccgugauggccuuccaccucaccacccgcaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcaucgucuccuggaagaacaaggagcucaagugcggcagcggcaucuucgugaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgagucccacaaccagaccuuccugaucgacggccccgagacggcggagugcccgaacaccaaccgcgccuggaacagccuggagguggaggacuacggguucggcgucuucaccaccaacaucuggcuccggcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggccaucauggcggucggcaugguguccauccuggccagcucccuccugaagaacgacauccccaugaccggcccccugguggccgggggccuccugaccgucugcuacgugcugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgucaucuccggccuguucccgaucagcauccccaucaccgccgccgccugguaccugugggaggugaagaagcagcgcgccggggugcucugggacguccccagcccgccgcccaugggcaaggcggagcuggaggacggggccuaccggaucaagcagaagggcaucuucggguacagccagaucggcgccggcguguacaaggaggggaccuuccacaccauguggcacgugacccgcggcgccguccugaugcacaaggggaagcggaucgagcccuccugggccgacgugaagaaggaccucaucagcuacggcgggggcuggaagcuggagggcgaguggaaggagggggaggaggugcagguccuggcgcucgagcccggcaagaacccccgcgccgugcagacgaagcccgggcuguucaagaccaacaccggcaccaucggggccgugucccuggacuucagccccggcacguccggcagccccaucaucgacaagaaggggaaggucgugggccucuacgggaacggcguggucacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccugcccgccaucgugcgcgaggccaucaagcgggggcuccgcacccugauccuggcgccgacccgggucguggccgccgagauggaggaggcccuccgcggccugcccauccgguaccagacccccgccauccgcgcggagcacacggggcgcgagaucguggaccugaugugccacgccaccuucaccaugcggcuccugagccccguccgcgugccgaacuacaaccugaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagacggugugguucgugccgagcaucaaggcggggaacgacaucgccgccugccuccgcaagaacggcaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccuggccgacggggaggagcgcgucauccucgccggccccaugccggugacccacagcuccgccgcccagcggcgcgggcggaucggccgcaaccccaagaacgagaacgaccaguacaucuacaugggggagccccuggagaacgacgaggacugcgcgcacuggaaggaggccaagaugcugcucgacaacaucaacacccccgagggcaucaucccgagcauguucgagcccgagcgggagaagguggacgccaucgacggcgaguaccgccugcgcggggaggcccggaagacguucgucgaccugaugcgccggggcgaccuccccguguggcuggccuacaagguggcggccgaggggaucaacuacgccgaccgccgguggugcuucgacggcaucaagaacaaccagauccuggaggagaacgucgagguggagaucuggaccaaggagggggagcgcaagaagcucaagccgcgguggcuggacgcccgcaucuacuccgacccccuggcccucaaggaguucaaggaguucgcggccggccggaagucccugacccugaaccucaucaccgagaugggccgccugcccacguucaugacccagaagacccgggacgcccuggacaaccucgccguccugcacaccgcggaggccgggggccgcgccuacaaccacgcccuguccgagcuccccgagacgcuggagacccugcuccugcugacccuccuggccaccgugaccggcgggaucuuccuguuccucaugagcgggcgggggaucggcaagaugacccuggggaugugcugcaucaucaccgcguccauccugcucugguacgcccagauccagccgcacuggaucgccgccagcaucauccuggaguucuuccugaucgugcuccugauccccgagcccgagaagcagcgcacgccccaggacaaccagcugaccuacgucgugaucgccauccucacgguggucgcggccaccauggccaacgagaugggcuuccuggagaagaccaagaaggaccuggggcucggcuccaucgccacccagcagccggagagcaacauccuggacaucgaccugcggcccgccuccgcguggacgcucuacgccguggccaccaccuucgugacccccaugcugcgccacagcaucgagaacagcuccgucaacgugagccugacggccaucgccaaccaggcgaccgugcucaugggccuggggaagggcuggccccuguccaagauggacaucggggucccgcuccuggccaucggcugcuacagccaggugaaccccaucacccugaccgccgcccuccugcugcucguggcgcacuacgccaucaucgggcccggccugcaggccaaggccacgcgggaggcccagaagcgcgcggccgccggcaucaugaagaaccccaccgucgacgggaucaccgugaucgaccuggacccgauccccuacgaccccaaguucgagaagcagcucggccaggugaugcugcugauccucugcgucacccaggugcugaugaugcggacgaccugggcccugugcgaggcccucacccuggcgaccgggcccaucuccacgcugugggagggcaacccggggcgcuucuggaacaccaccaucgccgugagcauggccaacaucuuccggggcuccuaccucgccggcgccgggcugcuguucagcaucaugaagaacaccacgaacgcgcgccgcggcaccgggaacaugggcgagacccucggcgagaaguggaagucccggcugaacgcccugggcaagagcgaguuccagaucuacaagaaguccggcauccaggaggucgaccgcacccucgccaaggaggggaucaagcggggcgagacggaccaccacgccgugagccgcggguccgcgaagcugcggugguucguggagcgcaacauggucacccccgagggcaaggugguggaccugggcugcgggcggggcggguggagcuacuacugcggcgggcucaagaacguccgcgaggugaagggccugaccaagggcgggcccggccacgaggagcccaucccgauguccaccuacggguggaaccuggugcggcuccagagcggcgucgacguguucuucaucccgcccgagaagugcgacacgcugcugugcgacaucggggaguccagccccaacccgaccguggaggccggccgcacccuccggguccugaaccugguggagaacuggcucaacaacaacacccaguucugcaucaaggugcugaaccccuacaugcccuccgucaucgagaagauggaggcccugcagcgcaaguacggcggggcccuggugcggaacccgcucagccgcaacagcacgcacgagauguacuggguguccaacgccagcggcaacaucgucuccagcgugaacaugaucucccggaugcugaucaaccgcuucaccaugcggcacaagaaggcgaccuacgagcccgacguggaccuggggagcggcacccgcaacaucgggaucgaguccgagauccccaaccucgacaucaucggcaagcggaucgagaagaucaagcaggagcacgagaccagcuggcacuacgaccaggaccaccccuacaagacgugggccuaccacggcuccuacgagaccaagcagaccgggagcgccuccagcauggucaacggcguggugcgccugcugaccaagccgugggacguccuccccacggugacccagauggccaugaccgacaccacgcccuucgggcagcagcgcguguucaaggagaaggucgacacccggacccaggagcccaaggagggcaccaagaagcugaugaagaucacggccgaguggcuguggaaggagcucggcaagaagaagaccccgcgcaugugcacccgggaggaguucacccgcaaggugcgguccaacgcggcccugggggccaucuucacggacgagaacaaguggaaguccgcccgcgaggccguggaggacucccgguucugggagcuggucgacaaggagcgcaaccuccaccuggagggcaagugcgagaccugcguguacaacaugauggggaagcgggagaagaagcugggcgaguucgggaaggcgaagggcagccgcgccaucugguacauguggcucggcgcccgguuccuggaguucgaggcccugggguuccucaacgaggaccacugguucucccgcgagaacagccuguccggcgucgagggggagggccugcacaagcucggguacauccugcgggacgugagcaagaaggagggcggcgcgauguacgccgacgacaccgccgggugggacacccgcaucacgcuggaggaccucaagaacgaggagauggugaccaaccacauggagggcgagcacaagaagcuggccgaggccaucuucaagcugaccuaccagaacaaggucgugcgggugcagcgccccacgccccgggggacggucauggacaucaucagccgccgggaccagcgcggcuccggccaggugggcaccuacggccucaacaccuucaccaacauggaggcgcagcugauccggcagauggagggggagggcguguucaagaacauccagcaccugacggucaccgaggagguggccgugcagaacuggcucgcccgcgucgggcgcgagcggcugagccgcauggccaucuccggcgacgacugcguggugaagccccuggacgaccgguucgccaacgcgcucaccgcccugaacgacaugggcaagauccgcaaggacauccagcagugggagccgagcaagggguggaacgacuggacccagguccccuucugcucccaccacuuccacgagcugaucaugaaggacggccgggugcucgugguccccugccgcaaccaggacgagcugaucgggcgggcccgcaucagccagggcgccggguggucccugcgggagacggccugccucggcaagagcuacgcgcagauguggucccugauguacuuccaccgccgggaccugcgccucgccgccaacgccaucugcagcgccgugcccucccacugggugccgaccagccggaccaccugguccauccacgcgaagcacgaguggaugacgaccgaggacaugcugaccgucuggaaccgcguguggauccgggagaaccccuggauggaggacaagacccccguggagagcugggaggagauccccuaccugggcaagcgcgaggaccaguggugcgggucccucaucggccugaccagccgggccacgugggccaagaacauccaggccgcgaucaaccagguccgcucccugaucgggaacgaggaguacaccgacuacaugccgagcaugaagcgguuccgccgcgaggaggaggaggccggcgugcucugguga

SEQ ID NO: 9539 - RNA, 9876 nt, Artificial Sequence
  derived and/or modified CDS sequence (opt1) from DENV-2__FJ410219__SS-prME
agcgccgggaugaucaucaugcugauccccaccgugauggccuuccaccucaccacccggaacggggagccgcacaugaucgucggcauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccagcaccugggugaccuacggcacgugcaccaccaccggcgagcaccgccgggagaagcgcagcgucgcccuggugccccacguggggaugggccucgagacgcggaccgagaccuggaugagcagcgagggggccuggaagcacgcccagcgcaucgagaccuggauccugcggcaccccggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugcccgacccagggcgagcccucccugaaggaggagcaggacaagcgguucgugugcaagcacagcaugguggaccgcggcugggggaacggcugcggccucuucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccugaugagcuccgggaaccuccuguucaccggccaccugaagugccggcuccgcauggacaagcugcagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccucgagaagcgcuacguccugggccggcugaucaccgugaacccgaucgugacggagaaggacucccccgucaacaucgaggccgagccgcccuucggggacagcuacaucaucaucggcguggagccggggcagcucaagcugaacugguucaagaagggcuccagcaucgggcagauguucgagaccaccaugcgcggcgcgaagcgcauggccauccugggcgacaccgccugggacuucgggucccucggcgggguguucacgagcaucggcaaggcccugcaccaggucuucggggccaucuacggcgcggccuucuccggcgugagcuggaccaugaagauccugaucggggugaucaucaccuggaucggcaugaacucccggagcaccucccugagcgucucccucgugcugguggggaucgucacgcuguaccucggcgugauggugcaggccgacagcgggugcgucguguccuggaagaacaaggagcugaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcucgagaaccugauguggaagcagaucacccccgagcugaaccacauccucgccgagaacgaggugaagcugaccaucaugaccggggacaucaagggcaucaugcaggccgggaagcgcuuccugcggccgcagcccacggagcucaaguacagcuggaagaccuggggcaaggccaagaugcuguccaccgagagcuacaaccagaccuuccugaucgacggccccgagacggcggagugcccgaacaccaaccgcgccuggaacucccucgagguggaggacuacggguucggcgucuucaccaccaacaucuggcugaagcugaaggagaagcaggacgccuucugcgacagcaagcucauguccgccgccaucaaggacaaccgggcggugcacgccgacaugggguacuggaucgagagcgcccugaacgacacguggaagaucgagaaggccuccuucaucgaggugaagaacugccacuggcccaagagccacacccugugguccaacggcguccucgagagcgagaugaucauccccaagaaccuggccggccccgugucccagcacaacuaccgcccgggguaccacacccagaucgcgggccccuggcaccuggggaagcucgagauggacuucgacuucugcgacggcaccaccgugaucgucacggaggacugcgggaaccggggccccagccugcgcaccaccaccgccuccggcaagcugaucacggaguggugcugccggagcugcacccucccgccccugcgcuaccgcggggaggacggcugcugguacgggauggagauccgcccccugaaggagaaggaggagaaccucgugaacagccuggugaccgccggccacgggcaggucgacaacuucucccugggcgugcucggcauggcccuguuccuggaggagaugcuccggacccgcguggggaugaagcacgcgauccugcuggucgccgugagcuucgugacgcucaucaccggcaacauguccuucaaggaccuggggcgggucguggugauggucggcgccaccaugaccgacgacaucgggaugggcgugacguaccuggcccuccuggccgcguucaaggugcgccccaccuucgccgccggccugcuccugcggaagcugaccagcaaggagcucaugaugaucaccaucgggaucguccugcugucccagagcacgauccccgagaccgugcucgagcugaccgacgcccuggcccucggcaugauggugcugaagaucguccgcaacauggagaaguaccagcuggcggugaccaucauggccauccucugcguccccaacgccgugauccugcagaacgccuggaagguguccugcacgauccuggccgucgugagcgugagcccccuccugcugaccagcucccagcagaagaccgacuggaucccccucgcgcugaccaucaaggggcugaaccccacggccaucuuccucaccacccugagccgcaccaacaagaagcgguccuggccgcugaacgaggccaucauggccgucggcauggugagcauccucgcguccagccugcugaagaacgacauccccaugacgggcccccucguggccgggggccugcugaccgucugcuacgugcucaccgggcgcuccgccgaccuggagcuggagcgggugaccgacgucaagugggaggaccaggccgagaucagcggcuccagccccauccucagcaucacgaucuccgaggacgggagcauguccaucaagaacgaggaggaggagcagacccugaccauccugauccgcaccggccuccuggugaucagcggccuguucccgaucuccauccccaucacggccgcggccugguaccucugggaggugaagaagcagcgggccgggguccugugggacgugcccuccccgccgcccaugggcaaggccgagcuggaggacggggccuaccgcaucaagcagaagggcauccucggguacucccagaucggcgcgggcguguacaaggaggggaccuuccacaccauguggcacgucacccggggcgccgugcugaugcacaaggggaagcgcaucgagcccagcugggccgacgugaagaaggaccugaucuccuacggcgggggcuggaagcucgagggcgaguggaaggagggggaggagguccaggugcuggcccuggagcccggcaagaacccccgggccgugcagaccaagcccggccucuucaagacgaacaccggcaccaucggggcggucagccuggacuucucccccggcaccagcggcucccccaucaucgacaagaaggggaagguggugggccuguacgggaacggcgucgugacgcgcagcggcgccuacguguccgccaucgcccagaccgagaaguccaucgaggacaaccccgagaucgaggacgacaucuuccggaagcgccggcugaccaucauggaccuccaccccggggccggcaagaccaagcgcuaccugcccgcgaucguccgggaggccaucaagcgcgggcugcggacgcucauccuggccccgacccgcgugguggccgcggagauggaggaggcccugcggggccuccccauccgcuaccagacccccgccauccgggccgagcacaccgggcgcgagaucgucgaccugaugugccacgccacguucaccaugcgccugcucucccccgugcgggugccgaacuacaaccugaucaucauggacgaggcgcacuucaccgaccccgccagcaucgccgcccgcggcuacaucuccacccgggucgagaugggcgaggccgcggggaucuucaugacggccacgccgcccggcagccgcgacccguucccccagagcaacgcccccaucaucgacgaggagcgggagauccccgagcgcuccuggaacagcgggcacgagugggugaccgacuucaagggcaagaccgugugguucgucccguccaucaaggccgggaacgacaucgccgcgugccugcggaagaacggcaagaaggugauccagcucagccgcaagacguucgacuccgaguacgugaagacccggaccaacgacugggacuucgucgugaccacggacaucagcgagaugggcgccaacuucaaggccgagcgcgugaucgacccccggcgcugcaugaagcccgucauccugaccgacggggaggagcgggugauccuggccggccccaugccggugacccacuccagcgcggcccagcgccgggggcgcaucggccggaaccccaagaacgagaacgaccaguacaucuacaugggggagccccucgagaacgacgaggacugcgcccacuggaaggaggccaagaugcugcuggacaacaucaacacccccgagggcaucaucccguccauguucgagcccgagcgcgagaaggucgacgccaucgacggcgaguaccggcuccgcggggaggcgcgcaagacguucguggaccugaugcggcgcggcgaccugcccguguggcucgccuacaaggucgccgccgaggggaucaacuacgccgaccggcgcuggugcuucgacggcaucaagaacaaccagauccuggaggagaacguggaggucgagaucuggaccaaggagggggagcggaagaagcugaagccgcgcuggcucgacgcgcggaucuacagcgacccccuggcccugaaggaguucaaggaguucgccgccggccgcaagucccucacccugaaccugaucaccgagaugggccggcuccccacguucaugacccagaagacccgcgacgcccuggacaaccuggcggugcuccacaccgccgaggccgggggccgggccuacaaccacgcgcugagcgagcugcccgagacgcucgagacccugcugcuccugacccugcucgccaccgugaccggcgggaucuuccuguuccugauguccgggcgcgggaucggcaagaugacccucgggaugugcugcaucaucaccgccagcauccugcugugguacgcccagauccagccgcacuggaucgccgcguccaucauccucgaguucuuccugaucguccugcucauccccgagcccgagaagcagcggacgccccaggacaaccagcugaccuacguggugaucgccauccugacggucguggccgccaccauggccaacgagaugggcuuccucgagaagaccaagaaggaccuggggcugggcagcaucgcgacccagcagccggaguccaacauccucgacaucgaccugcgccccgccagcgccuggacgcuguacgccguggccaccaccuucgucacccccaugcuccggcacuccaucgagaacagcagcgugaacgugucccugacggcgaucgccaaccaggccaccguccugaugggccucgggaagggcuggccccugagcaagauggacaucggggugccgcugcucgccaucggcugcuacucccaggugaaccccaucacccugaccgccgcgcugcuccugcuggucgcccacuacgccaucaucgggcccggccuccaggccaaggcgacgcgcgaggcccagaagcgggccgccgccggcaucaugaagaaccccaccguggacgggaucaccgugaucgaccuggacccgauccccuacgaccccaaguucgagaagcagcugggccaggucaugcuccugauccugugcgugacccaggugcucaugaugcgcacgaccugggcgcugugcgaggcccugacccucgccaccgggcccaucagcacgcugugggagggcaacccggggcgguucuggaacaccaccaucgccgucuccauggccaacaucuuccgcggcagcuaccuggcgggcgccgggcuccuguucuccaucaugaagaacaccacgaacacccggcgcggcaccgggaacaugggcgagacccugggcgagaaguggaagucccgccucaacgcccuggggaaguccgaguuccagaucuacaagaaguccggcauccaggagguggaccggacgcuggccaaggaggggaucaagcgcggcgagaccgaccaccacgccgugucccgggggagcgcgaagcuccgcugguucgucgagcggaacauggugacccccgagggcaagguggucgaccugggcugcgggcgcggcgggugguccuacuacugcggcgggcugaagaacgugcgggaggugaagggccucaccaagggcgggcccggccacgaggagcccaucccgaugagcacguacggguggaaccugguccgccugcaguccggcguggacguguucuucaucccgcccgagaagugcgacacccuccugugcgacaucggggagagcucccccaacccgaccgucgaggccggccggacccugcgcgugcucaaccugguggagaacuggcugaacaacaacacgcaguucugcaucaagguccugaaccccuacaugcccagcgugaucgagaagauggaggcccuccagcggaaguacggcggggcccuggugcgcaacccgcugucccggaacagcacccacgagauguacugggucagcaacgcguccggcaacaucgugagcuccgugaacaugaucagccgcaugcucaucaaccgguucaccaugcgccacaagaaggccaccuacgagcccgacgucgaccugggguccggcacccggaacaucgggaucgagagcgagauccccaaccuggacaucaucggcaagcgcaucgagaagaucaagcaggagcacgagacguccuggcacuacgaccaggaccaccccuacaagaccugggccuaccacggcagcuacgagaccaagcagaccggguccgccagcuccauggugaacggcgugguccggcuccugacgaagccgugggacgugcugcccaccgugacccagauggccaugaccgacacgacccccuucgggcagcagcgcgucuucaaggagaagguggacacccgcacccaggagcccaaggagggcacgaagaagcucaugaagaucaccgcggaguggcuguggaaggagcugggcaagaagaagaccccgcggaugugcacccgcgaggaguucacgcggaaggugcgcagcaacgccgcccucggggccaucuucaccgacgagaacaaguggaaguccgcccgggaggcggucgaggacagccgcuucugggagcugguggacaaggagcggaaccugcaccucgagggcaagugcgagaccugcgucuacaacaugauggggaagcgcgagaagaagcugggcgaguucgggaaggccaagggcucccgggccaucugguacauguggcugggcgcccgcuuccucgaguucgaggcccugggguuccugaacgaggaccacugguucagccgggagaacucccucagcggcguggagggggagggccugcacaagcugggguacauccuccgcgacguguccaagaaggagggcggcgcgauguacgccgacgacaccgccgggugggacacgcggaucacccuggaggaccugaagaacgaggagauggucaccaaccacauggagggcgagcacaagaagcucgccgaggcgaucuucaagcugaccuaccagaacaagguggugcgcguccagcggcccacgccccgcgggaccgugauggacaucaucagccggcgcgaccagcggggcagcggccagguggggaccuacggccugaacaccuucacgaacauggaggcccagcucauccgccagauggagggggagggcgucuucaagaacauccagcaccugaccgugaccgaggagguggccgucaagaacuggcuggcccggguggggcgcgagcgccucucccggauggccaucagcggcgacgacugcguggucaagccccuggacgaccgcuucgcgaacgcccugaccgcccucaacgacaugggcaagauccggaaggacauccagcagugggagccguccaagggguggaacgacuggacccaggugcccuucugcagccaccacuuccacgagcugaucaugaaggacggccgcgugcuggucgugcccugccggaaccaggacgagcucaucgggcgcgcccggaucucccagggcgccggguggagccugcgcgagaccgcgugccugggcaaguccuacgcccagauguggagccucauguacuuccaccggcgcgaccugcggcuggccgccaacgccaucugcuccgcggugcccagccacugggucccgaccucccgcaccacguggagcauccacgccaagcacgaguggaugaccaccgaggacaugcucaccguguggaaccggguguggauccgcgagaaccccuggauggaggacaagacccccgucgaguccugggaggagauccccuaccugggcaagcgggaggaccaguggugcgggagccugaucggccucacgucccgcgccaccugggccaagaacauccaggccgcgaucaaccaggugcggagccugaucgggaacgaggaguacaccgacuacaugccguccaugaagcgcuuccggcgcgaggaggaggaggccggcgugcugugguga

SEQ ID NO: 9540 - RNA, 9876 nt, Artificial Sequence
  derived and/or modified CDS sequence (opt1) from DENV-2__FJ461314__SS-prME
agcgcggggaugaucaucaugcugauccccaccgugauggccuuccaccucaccacccggaacggggagccgcacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacgcggaccgagaccuggauguccagcgagggggccuggaagcacgcccagcgcaucgagaccuggauccugcggcaccccggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugcccgacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggacccugaagauccugaucggggugaucaucaccuggaucggcaugaacucccggagcaccucccugagcgucucccucgugcugguggggaucgucacgcuguaccucggcgugauggugcaggccgacagcgggugcgucguguccuggaagaacaaggagcugaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcucgagaaccugauguggaagcagaucacccccgagcugaaccacauccucgccgagaacgaggugaagcugaccaucaugaccggggacaucaagggcaucaugcaggccgggaagcgcagccugcggccgcagcccacggagcucaaguacuccuggaagaccuggggcaaggccaagaugcugagcaccgaguccuacaaccagaccuuccugaucgacggccccgagacggcggagugcccgaacaccaaccgcgccuggaacagccucgagguggaggacuacggguucggcgucuucaccaccaacaucuggcugaagcugaaggagaagcaggacgccuucugcgacuccaagcucaugagcgccgccaucaaggacaaccgggcggugcacgccgacaugggguacuggaucgaguccgcccugaacgacacguggaagaucgagaaggccagcuucaucgaggugaagaacugccacuggcccaagucccacacccuguggagcaacggcguccucgaguccgagaugaucauccccaagaaccuggccggccccgugagccagcacaacuaccgcccgggguaccacacccagaucgcgggccccuggcaccuggggaagcucgagauggacuucgacuucugcgacggcaccaccgugaucgucacggaggacugcgggaaccggggccccucccugcgcaccaccaccgccagcggcaagcugaucacggaguggugcugccggagcugcacccucccgccccugcgcuaccgcggggaggacggcugcugguacgggauggagauccgcccccugaaggagaaggaggagaaccucgugaacucccuggugaccgccggccacgggcaggucgacaacuucagccugggcgugcucggcauggcccuguuccuggaggagaugcuccggacccgcguggggacgaagcacgcgauccugcuggucgccguguccuucgugacccucaucaccggcaacaugagcuucaaggaccuggggcgggucguggugauggucggcgccaccauggccgacgacaucgggaugggcgugacguaccuggcccuccuggcggccuucaaggugcgccccaccuucgccgccggccugcuccugcggaagcugaccuccaaggagcucaugaugaccacgaucgggaucguccugcugagccaguccaccauccccgagaccgugcucgagcugaccgacgcccuggcgcucggcaugauggugcugaagaucguccgcaacauggagaaguaccagcuggccgugacgaucauggccauccucugcguccccaacgccgugauccugcagaacgccuggaaggugagcugcaccauccuggcggucguguccgugagcccccuccugcugaccuccagccagcagaagaccgacuggaucccccucgcccugacgaucaaggggcugaaccccaccgccaucuuccucaccacccugucccgcacgaacaagaagcggagcuggccgcugaacgaggccaucauggcggucggcaugguguccauccucgccagcucccugcugaagaacgacauccccaugaccggcccccucguggccgggggccugcugaccgucugcuacgugcucaccgggcgcagcgccgaccuggagcuggagcgggccacggacgugaagugggaggaccaggcggagaucuccggcagcagccccauccucuccaucaccaucagcgaggacggguccaugagcaucaagaacgaggaggaggagcagacccugaccauccugauccgcacgggccuccuggucaucuccggccuguucccgaucagcauccccaucaccgccgccgccugguaccucugggaggugaagaagcagcgggccggggugcugugggacguccccagcccgccgcccaugggcaaggcggagcuggaggacggggccuaccgcaucaagcagaagggcauccucggguacagccagaucggcgccggcguguacaaggaggggaccuuccacaccauguggcacgugacccggggcgccguccugaugcacaaggggaagcgcaucgagcccuccugggccgacgugaagaaggaccugaucagcuacggcgggggcuggaagcucgagggcgaguggaaggagggggaggaggugcagguccuggcgcuggagcccggcaagaacccccgggccgugcagacgaagcccggccucuucaagaccaacaccggcaccaucggggccgugucccuggacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccuccaccccggggccggcaagacgaagcgcuaccugcccgccaucgugcgggaggccaucaagcgcgggcugcggacccucauccuggcgccgacccgcgucguggccgccgagauggaggaggcccugcggggccuccccauccgcuaccagacccccgccauccgggcggagcacacggggcgcgagaucguggaccugaugugccacgccaccuucaccaugcgccugcucagccccguccgggugccgaacuacaaccugaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcucucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccugaccgacggggaggagcgggucauccuggccggccccaugccggugacccacagcuccgccgcccagcgccgggggcgcaucggccggaaccccaagaacgagaacgaccaguacaucuacaugggggagccccucgagaacgacgaggacugcgcccacuggaaggaggcgaagaugcugcuggacaacaucaacacgcccgagggcaucaucccgagcauguucgagcccgagcgcgagaagguggacgccaucgacggcgaguaccggcuccgcggggaggcccgcaagaccuucgucgaccugaugcggcgcggcgaccugcccguguggcucgccuacaagguggccgcggaggggaucaacuacgccgaccggcgcuggugcuucgacggcaucaagaacaaccagauccuggaggagaacgucgagguggagaucuggaccaaggagggggagcggaagaagcugaagccgcgcuggcucgacgcccggaucuacuccgacccccuggcccugaaggaguucaaggaguucgccgcgggccgcaagagccucacccugaaccugaucacggagaugggccggcuccccaccuucaugacccagaagacccgcgacgcccuggacaaccuggccguccuccacacggccgaggccggcgggcgggccuacaaccacgcccuguccgagcugcccgagacccucgagacccugcugcuccugacccugcucgccacggugaccgggggcaucuuccuguuccugaugagcggccgcgggaucggcaagaugacccucgggaugugcugcaucaucaccgccuccauccugcugugguacgcgcagauccagccgcacuggaucgccgccagcaucauccucgaguucuuccugaucgugcugcucauccccgagcccgagaagcagcggacgccccaggacaaccagcugacguacgucgugaucgccauccugaccguggucgccgcgaccauggccaacgagaugggcuuccucgagaagaccaagaaggaccuggggcugggcuccaucgccacgcagcagccggagagcaacauccucgacaucgaccugcgccccgccuccgccuggacccuguacgcgguggccaccaccuucgugacgcccaugcuccggcacagcaucgagaacagcuccgucaacgugagccugaccgccaucgccaaccaggccaccgugcugaugggccucgggaagggcuggccccuguccaagauggacaucggggucccgcugcucgcgaucggcugcuacagccaggugaaccccaucacccugacggccgcccugcuccugcugguggcccacuacgcgaucaucgggcccggccuccaggccaaggccacccgcgaggcccagaagcgggccgcggccggcaucaugaagaaccccaccgucgacgggaucaccgugaucgaccuggacccgauccccuacgaccccaaguucgagaagcagcugggccaggugaugcuccugauccugugcgucacccaggugcucaugaugcgcaccaccugggcccugugcgaggcccugacccucgccacggggcccaucuccacccugugggagggcaacccggggcgguucuggaacaccaccaucgcggugagcauggccaacaucuuccgcggcuccuaccuggccggcgccgggcuccuguucagcaucaugaagaacacgaccaacacccggcgcggcaccgggaacaugggcgagacgcugggcgagaaguggaagucccgccucaacacccugggcaagagcgaguuccagaucuacaagaaguccgggauccaggaggucgaccggacccuggccaaggaggggaucaagcgcggcgagaccgaccaccacgcggugagccggggguccgccaagcuccgcugguucguggagcggaacauggucacgcccgagggcaaggugguggaccugggcugcgggcgcggcggguggagcuacuacugcggcgggcugaagaacguccgggaggugaagggccucaccaagggcgggcccggccacgaggagcccaucccgauguccaccuacggguggaaccuggugcgccugcagagcggcgucgacguguucuucaucccgcccgagaagugcgacacccuccugugcgacaucggggaguccagccccaacccgacgguggaggccggccggacccugcgcguccucaaccugguggagaacuggcugaacaacaacacccaguucugcaucaaggugcugaaccccuacaugcccuccgucaucgagaagauggaggcccuccagcggaaguacggcggggcgcuggugcgcaacccgcugagccggaacagcacccacgagauguacuggguguccaacgccagcggcaacaucgucuccagcgugaacaugaucucccgcaugcucaucaaccgguucaccaugcgccacaagaaggccacguacgagcccgacguggaccuggggagcggcacccggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggucaacggcguggugcggcuccugaccaagccgugggacguccugcccaccgugacgcagauggcgaugaccgacaccacccccuucgggcagcagcgcguguucaaggagaaggucgacacgcgcacccaggagcccaaggagggcaccaagaagcucaugaagaucaccgccgaguggcuguggaaggagcugggcaagaagaagacgccgcggaugugcacccgcgaggaguucacccggaaggugcgcuccaacgccgcccucggggccaucuucaccgacgagaacaaguggaaguccgcgcgggaggccguggaggacucccgcuucugggagcuggucgacaaggagcggaaccugcaccucgagggcaagugcgagacgugcguguacaacaugauggggaagcgcgagaagaagcugggcgaguucgggaaggccaagggcagccgggccaucugguacauguggcugggcgcccgcuuccucgaguucgaggcgcugggguuccugaacgaggaccacugguucucccgggagaacagccucuccggcgucgagggggagggccugcacaagcugggguacauccuccgcgacgugagcaagaaggagggcggcgccauguacgccgacgacaccgccgggugggacacccggaucacccuggaggaccugaagaacgaggagauggugacgaaccacauggagggcgagcacaagaagcucgcggaggccaucuucaagcugaccuaccagaacaaggucgugcgcgugcagcggcccacgccccgcgggaccgucauggacaucaucagccggcgcgaccagcggggcuccggccagguggggaccuacggccugaacaccuucaccaacauggaggcccagcucauccgccagauggagggggagggcguguucaagaacauccagcaccugaccgucacggaggagguggccgugcagaacuggcuggcccgggucgggcgcgagcgccucagccggauggcgaucuccggcgacgacugcguggugaagccccuggacgaccgcuucgccaacgcccugaccgcccucaacgacaugggcaagauccggaaggacauccagcagugggagccgagcaagggguggaacgacuggacccagguccccuucugcucccaccacuuccacgagcugaucaugaaggacggccgcgugcuggugguccccugccggaaccaggacgagcucaucgggcgcgcccggaucagccagggcgcgggguggucccugcgcgagaccgccugccugggcaagagcuacgcccagauguggucccucauguacuuccaccggcgcgaccugcggcuggccgccaacgcgaucugcagcgccgugcccucccacugggugccgacgagccgcaccaccugguccauccacgccaagcacgaguggaugaccaccgaggacaugcucacggucuggaaccggguguggauccgcgagaaccccuggauggaggacaagacccccguggagagcugggaggagauccccuaccugggcaagcgggaggaccaguggugcgggucccugaucggccucaccagccgcgccaccugggccaagaacauccaggcggccaucaaccagguccggucccugaucgggaacgaggaguacacggacuacaugccgagcaugaagcgcuuccggcgcgaggaggaggaggccggcgugcugugguga

SEQ ID NO: 9541 - RNA, 9876 nt, Artificial Sequence
  derived and/or modified CDS sequence (opt1) from DENV-2__FJ410221__SS-prME
agcgccgggaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaucauggccgacgacaucgggaucggcgugaccuaccuggcccugcucgcggccuucaaggugcgccccacguucgccgccggccugcugcuccggaagcugaccuccaaggagcugaugaugaccaccaucgggaucguccuccugagccaguccacgauccccgagaccgugcuggagcucaccgacgcccuggcgcugggcaugauggugcucaagaucguccgcaacauggagaaguaccagcuggccgugaccaucauggccauccugugcgucccgaacgccgugauccuccagaacgccuggaaggugagcugcacgauccuggcggucguguccgugagcccccugcuccugaccuccagccagcagaagaccgacuggaucccccuggcccucaccaucaaggggcugaaccccacggccaucuuccugaccacccucucccgcaccaacaagaagcggagcuggccgcugaacgaggccaucauggcggucggcaugguguccauccuggccagcucccuccugaagaacgacauccccaugacgggcccccugguggccgggggccuccugaccgucugcuacgugcugaccgggcgcagcgccgaccucgagcuggagcgggccaccgacgugaagugggaggaccaggcggagaucuccggcagcagccccauccuguccaucacgaucagcgaggacggguccaugagcaucaagaacgaggaggaggagcagacccucaccauccugauccgcaccggccugcucgucaucuccggccuguucccgaucagcauccccaucacggccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagaccaagcccgggcuguucaagacgaacaccggcaccaucggggccgugucccucgacuucagccccggcaccuccggcagccccaucaucgacaagaaggggaaggucgugggccuguacgggaacggcguggucacgcgcuccggcgccuacgugagcgccaucgcgcaguccgagaaguccaucgaggacaaccccgagaucgaggacgacaucuuccggaagcgccggcugaccaucauggaccugcaccccggggccggcaagaccaagcgcuaccuccccgccaucgugcgggaggccaucaagcgcgggcugcggacccugauccucgcgccgacgcgcgucguggccgccgagauggaggaggcccugcggggccugcccauccgcuaccagacccccgccauccggguggagcacaccgggcgcgagaucgucgaccucaugugccacgcgaccuucacgaugcgccugcugucccccgugcgggugccgaacuacaaccucaucaucauggacgaggcccacuucaccgaccccgccagcaucgccgcccgcggcuacaucagcacccgggucgagaugggcgaggcggccgggaucuucaugaccgccacgccgcccggcucccgcgacccguucccccagagcaacgcccccaucaucgacgaggagcgggagauccccgagcgcuccuggaacagcgggcacgagugggugaccgacuucaagggcaagaccgugugguucgucccguccaucaaggccgggaacgacaucgcggccugccugcggaagaacggcaagaaggugauccagcugagccgcaagaccuucgacuccgaguacgugaagacgcggaccaacgacugggacuucgucgugaccaccgacaucagcgagaugggcgccaacuucaaggccgagcgcgugaucgacccccggcgcugcaugaagcccgucauccucacggacggggaggagcgggugauccuggcgggccccaugccggugacccacuccagcgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgcgagaaggucgacgcgaucgacggcgaguaccggcugcgcggggaggcccgcaagaccuucguggaccucaugcggcgcggcgaccugcccguguggcuggccuacaaggucgccgccgaggggaucaacuacgcggaccggcgcuggugcuucgacggcaucaagaacaaccagauccucgaggagaacguggaggucgagaucuggacgaaggagggggagcggaagaagcugaagccgcgcuggcuggacgcccggaucuacagcgacccccucgcccugaaggaguucaaggaguucgccgccggccgcaagucccugacccucaaccugaucaccgagaugggccggcugcccaccuucaugacgcagaagacccgcgacgcgcucgacaaccuggccgugcugcacaccgccgaggccgggggccgggcguacaaccacgcccucagcgagcugcccgagacccuggagacgcuccugcugcucacccugcuggccaccgugaccgggggcaucuuccucuuccugauguccggccgcgggaucggcaagaugacgcuggggaugugcugcaucaucaccgccagcauccuccugugguacgcccagauccagccgcacuggaucgcggccuccaucauccuggaguucuuccucaucguccugcugauccccgagcccgagaagcagcggacgccccaggacaaccagcucaccuacguggugaucgccauccugaccgucguggccgccacgauggcgaacgagaugggcuuccuggagaagaccaagaaggaccucgggcugggcagcaucgccacccagcagccggaguccaacauccuggacaucgaccuccgccccgccagcgccuggacccuguacgccguggcgacgaccuucgucacccccaugcugcggcacagcaucgagaacuccagcgugaacgugucccucaccgccaucgccaaccaggccacgguccugaugggccuggggaagggcuggccccucagcaagauggacaucggggugccgcugcuggccaucggcugcuacucccaggugaaccccaucacccucaccgcggcccugcugcuccuggucgcccacuacgccaucaucgggcccggccugcaggcgaaggccacccgcgaggcccagaagcgggccgccgcgggcaucaugaagaaccccacgguggacgggaucaccgugaucgaccucgacccgauccccuacgaccccaaguucgagaagcagcugggccaggucaugcugcucauccugugcgugacccaggugcugaugaugcgcaccacgugggcccucugcgaggcccugacccuggccaccgggcccaucagcacccucugggagggcaacccggggcgguucuggaacacgaccaucgccgucuccauggcgaacaucuuccgcggcagcuaccuggccggcgccgggcuccucuucuccaucaugaagaacaccaccaacacgcggcgcggcaccgggaacaucggcgagacccugggcgagaaguggaagucccgccugaacgcccucgggaaguccgaguuccagaucuacaagaaguccggcauccaggagguggaccggacccuggccaaggaggggaucaagcgcggcgagacggaccaccacgcggugucccgggggagcgccaagcugcgcugguucgucgagcggaacauggugacccccgagggcaagguggucgaccucggcugcgggcgcggcgggugguccuacuacugcggcgggcugaagaacgugcgggaggugaagggccugaccaagggcgggcccggccacgaggagcccaucccgaugagcaccuacggguggaaccucguccgccugcaguccggcguggacguguucuucaucccgcccgagaagugcgacacgcugcucugcgacaucggggagagcucccccaacccgaccgucgaggccggccggacccugcgcgugcugaaccucguggagaacuggcugaacaacaacacccaguucugcaucaagguccugaaccccuacaugcccagcgugaucgagaagauggaggcccugcagcggaaguacggcggggcgcucgugcgcaacccgcugagccggaacuccacgcacgagauguacugggucagcaacgccuccggcaacaucgugagcuccgugaacaugaucagccgcaugcugaucaaccgguucaccaugcgccacaagaaggccaccuacgagcccgacgucgaccucggguccggcacccggaacguggggaucgagagcgagauccccaaccuggacaucaucggcaagcgcaucgagaagaucaagcaggagcacgagaccuccuggcacuacgaccaggaccaccccuacaagacgugggccuaccacggcagcuacgagaccaagcagaccggguccgccagcuccauggugaacggcgucgugcggcugcucaccaagccgugggacgugcugcccacggucacccagauggcgaugaccgacaccacgcccuucgggcagcagcgcguguucaaggagaagguggacacccgcacccaggagcccaaggagggcaccaagaagcugaugaagaucacggccgaguggcucuggaaggagcugggcaagaagaagaccccgcggaugugcacccgcgaggaguucacccggaagguccgcagcaacgccgcccugggggccaucuucacggacgagaacaaguggaaguccgcgcgggaggccguggaggacagccgcuucugggagcucgucgacaaggagcggaaccugcaccuggagggcaagugcgagaccugcguguacaacaugauggggaagcgcgagaagaagcucggcgaguucgggaaggccaagggcucccgggccaucugguacauguggcugggcgcccgcuuccuggaguucgaggcgcucggguuccugaacgaggaccacugguucagccgggagaacucccugagcggcguggagggggagggccuccacaagcugggguacauccugcgcgacgucagcaagaaggagggcggcgccauguacgccgacgacaccgccgggugggacacccggaucacgcucgaggaccugaagaacgaggagauggugaccaaccacauggagggcgagcacaagaagcuggcggaggccaucuucaagcucaccuaccagaacaaggugguccgcgugcagcggcccacgccccgggggacggugauggacaucaucucccggcgcgaccagcggggcagcgggcaggucggcaccuacggccugaacaccuucaccaacauggaggcccagcugauccgccagauggagggggagggcguguucaagaacauccagcaccucacggugaccgaggaggucgccgugcagaacuggcuggcccggguggggcgcgagcgccugucccggauggcgaucagcggcgacgacugcgucgugaagccccucgacgaccgcuucgccaacgcccugaccgcccugaacgacaugggcaagauccggaaggacauccagcagugggagccguccaagggguggaacgacuggacccaggugcccuucugcagccaccacuuccacgagcucaucaugaaggacggccgcguccugguggugcccugccggaaccaggacgagcugaucgggcgcgcccggaucucccagggcgcgggguggagccuccgcgagacggccugccugggcaaguccuacgcccagauguggagccugauguacuuccaccggcgcgaccuccggcuggccgccaacgcgaucugcuccgccguccccagccacugggugccgaccucccgcaccaccuggagcauccacgccaagcacgaguggaugacgaccgaggacaugcugaccguguggaaccgggucuggauccgcgagaaccccuggauggaggacaagacccccguggaguccugggaggagauccccuaccucggcaagcgggaggaccaguggugcgggagccugaucggccugaccucccgcgccacgugggccaagaacauccaggcggccaucaaccaggugcggagccucaucgggaacgaggaguacaccgacuacaugccgagcaugaagcgcuuccggcgcgaggaggaggaggccggcguccugugguga

SEQ ID NO: 9542 - RNA, 9876 nt, Artificial Sequence
  derived and/or modified CDS sequence (opt1) from DENV-2__FJ547064__SS-prME
agcgccgggaugaucaucaugcugauccccaccgugauggccuuccaccucaccacccggaacggggagccccacauggucguggggauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccuccaccugggucaccuacgggaccugcaccaccaccggcgagcaccgccgggagaagcgcagcguggcccuggugccccacgucgggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcgugcucaucuucauccugcugacggccguggcccccuccaugaccaugcggugcaucggcaucagcaaccgcgacuucgucgagggcguguccgggggcagcuggguggacaucguccucgagcacggguccugcgugaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcauggucgaccgcggcugggggaacggcugcggccuguucggcaagggcgggaucgugacgugcgccauguucacgugcaagaagaacauggagggcaagaucgugcagcccgagaaccuggaguacaccaucgucgugacgccccacuccggggaggagcacgcggugggcaacgacacggggaagcacggccaggagaucaaggucaccccgcagagcuccaucaccgaggccgagcugaccggguacggcaccgugacgauggagugcagcccccggaccggccucgacuucaacgagauggugcugcugcagauggagaacaaggccuggcucguccaccgccagugguuccuggaccugccccuccccuggcugccgggggccgacaagcaggaguccaacuggauccagaaggagacccuggugaccuucaagaacccccacgccaagaagcaggacgucguggugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaaggucgugaaggagaucgccgagacccagcacggcaccaucgugauccggguccaguacgagggggacggcagccccugcaagauccccuucgagaucauggaccuggagaagcgcuacgugcucggccggcugaucaccgugaacccgaucgucacggagaaggacucccccgugaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcggggucuucacgagcaucggcaaggcccuccaccagguguucggggccaucuacggcgcggccuucuccggcgugagcuggaccaugaagauccugaucggggucaucaucaccuggaucggcaugaacucccggagcaccucccugagcgugucccuggugcucgucgggaucgugacgcuguaccugggcgugaugguccaggccgacagcgggugcgugguguccuggaagaacaaggagcucaagugcggcagcggcaucuucaucaccgacaacguccacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggaggucgaggacuacggguucggcguguucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgucaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgucaccgccggccacggccagguggacaacuucagccugggcgugcugggcauggcccucuuccuggaggagaugcugcggacccgcgucgggacgaagcacgcgauccuccugguggccguguccuucgucacccugaucaccggcaacaugagcuucaaggaccucgggcgggugguggucauggugggcgccaccaugacggacgacaucgggaugggcgugaccuaccuggcccugcucgccgcguucaagguccgccccaccuucgccgccggccugcugcuccggaagcugaccuccaaggagcugaugaugacgaccaucgggaucgugcuccugagccaguccaccauccccgagaccgugcuggagcucacggacgcccuggcccugggcaugaugguccucaagaucgugcgcaacauggagaaguaccagcuggcggucaccaucauggccauccugugcgugccgaacgccgugauccuccagaacgccuggaaggucagcugcaccauccuggccgugguguccgucagcccccugcuccugaccuccagccagcagaagacggacuggaucccccuggcgcucaccaucaaggggcugaaccccaccgccaucuuccugaccacgcucucccgcaccaacaagaagcggagcuggccgcugaacgaggccaucauggccgugggcaugguguccauccuggcgagcucccuccugaagaacgacauccccaugaccggcccccuggucgccgggggccuccugaccgugugcuacgugcugacggggcgcagcgccgaccucgagcuggagcgggccaccgacgucaagugggaggaccaggccgagaucuccggcagcagccccauccuguccaucaccaucagcgaggacggguccaugagcaucaagaacgaggaggaggagcagacccucacgauccugauccgcaccggccugcucgugaucuccggccuguucccgaucagcauccccaucaccgcggccgccugguaccugugggaggugaagaagcagcgggccgggguccucugggacgugcccagcccgccgcccaugggcaaggccgagcuggaggacggggcguaccgcaucaagcagaagggcauccugggguacagccagaucggcgccggcguguaccgggaggggaccuuccacaccauguggcacgucacgcgcggcgccgugcucaugcacaaggggaagcggaucgagcccuccugggccgacgugaagaaggaccugaucagcuacggcgggggcuggaagcuggagggcgaguggaaggagggggaggagguccaggugcucgcccuggagcccggcaagaacccccgcgcggugcagaccaagcccgggcuguucaagaccaacaccggcacgaucggggccgucucccucgacuucagccccggcaccuccggcagccccaucaucgacaagaaggggaagguggugggccuguacgggaacggcgucgugacccgguccggcgccuacgugagcgccaucgcccagaccgagaaguccaucgaggacaaccccgagaucgaggacgacaucuuccgcaagcggcgccugacgaucauggaccugcaccccggggcgggcaagaccaagcgguaccuccccgccaucguccgcgaggccaucaagcgggggcugcgcacccugauccucgccccgacccgggugguggcggccgagauggaggaggcccugcgcggccugcccauccgguaccagacgcccgccauccgcgccgagcacaccgggcgcgagaucgucgaccucaugugccacgcgaccuucaccaugcggcugcugagccccgugcgcgugccgaacuacaaccucaucaucauggacgaggcccacuucacggaccccgccuccaucgccgcccggggcuacaucagcacccgcgucgagaugggcgaggcggccgggaucuucaugaccgccacgccgcccggcagccgggacccguucccccaguccaacgcccccaucaucgacgaggagcgcgagauccccgagcggagcuggaacuccgggcacgagugggugacggacuucaagggcaagaccgugugguucgucccgagcaucaaggccgggaacgacaucguggcgugccugcgcaagaacggcaagaaggugauccagcugucccggaagaccuucgacagcgaguacgucaagacccgcacgaacgacugggacuucguggugaccaccgacaucuccgagaugggcgccaacuucaaggccgagcgggucaucgacccccgccggugcaugaagcccgugauccucaccgacggggaggagcgcgugauccuggccggccccaugccggucacgcacagcuccgcggcccagcggcgcgggcggaucggccgcaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgggagaagguggacgccaucgacggcgaguaccgccugcgcggggaggcgcggaagaccuucguggaccucaugcgccggggcgaccugcccgucuggcuggccuacaagguggccgccgaggggaucaacuacgccgaccgccgguggugcuucgacggcaucaagaacaaccagauccucgaggagaacgucgagguggagaucuggaccaaggagggggagcgcaagaagcugaagccgcgguggcuggacgcgcgcaucuacuccgacccccucgcccugaaggaguucaaggaguucgccgccggccggaagucccugacgcucaaccugaucaccgagaugggccgccugcccaccuucaugacccagaagacgcgggacgcccucgacaaccuggcggugcugcacaccgccgaggccgggggccgcgccuacaaccacgcgcucuccgagcugcccgagacccuggagacccuccugcugcucacgcugcuggccaccgucaccgggggcaucuuccucuuccugaugagcggccgggggaucggcaagaugacccuggggaugugcugcaucaucaccgccuccauccuccugugguacgcccagauccagccgcacuggaucgccgcgagcaucauccuggaguucuuccucaucgugcugcugauccccgagcccgagaagcagcgcacgccccaggacaaccagcucaccuacguggucaucgccauccugaccgugguggccgccaccauggccaacgagaugggcuuccuggagaagacgaagaaggaccucgggcugggcuccaucgcgacccagcagccggagagcaacauccuggacaucgaccuccggcccgccuccgccuggacccuguacgccgucgccaccacguucgugacccccaugcugcgccacagcaucgagaacagcuccgugaacgucagccucaccgcgaucgccaaccaggccaccgugcugaugggccuggggaagggcuggccccucuccaagauggacaucggggugccgcugcuggccaucggcugcuacagccaggucaaccccaucacgcucaccgccgcgcugcugcuccugguggcccacuacgccaucaucgggcccggccugcaggccaaggcgacccgggaggcccagaagcgcgccgccgccggcaucaugaagaaccccaccguggacgggaucacggucaucgaccucgacccgauccccuacgaccccaaguucgagaagcagcugggccaggugaugcugcucauccugugcgugacccagguccugaugaugcggaccaccugggcgcucugcgaggcccugacgcuggccaccgggcccaucuccacccucugggagggcaacccggggcgcuucuggaacaccacgaucgccgugagcauggccaacaucuuccggggcuccuaccuggcgggcgccgggcuccucuucagcaucaugaagaacaccaccaacacccgccgcggcacggggaacaugggcgagacccugggcgagaaguggaagucccggcugaacgcccucggcaagagcgaguuccagaucuacaagaaguccggcauccaggagguggaccgcacccuggccaaggaggggaucaagcggggcgagaccgaccaccacgccgucagccgcggguccgcgaagcugcggugguucguggagcgcaacauggugacgcccgagggcaaggucguggaccucggcugcgggcggggcggguggagcuacuacugcggcgggcugaagaacgugcgcgaggucaagggccugaccaagggcgggcccggccacgaggagcccaucccgauguccaccuacggguggaaccucgugcggcugcagagcggcguggacgucuucuucaucccgcccgagaagugcgacacccugcucugcgacaucggggaguccagccccaacccgacgguggaggccggccgcacccugcgggugcugaaccucgucgagaacuggcugaacaacaacauccaguucugcaucaaggugcugaaccccuacaugcccuccgugaucgagaagauggaggcccugcagcgcaaguacggcggggcccucguccggaacccgcugagccgcaacagcacccacgagauguacuggguguccaacgcgagcggcaacaucguguccagcgucaacaugaucucccggaugcugaucaaccgcuucaccaugcggcacaagaaggccaccuacgagcccgacguggaccucgggagcggcacgcgcaacaucgggaccgaguccgagauccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggugaacggcgucgugcgccugcucaccaagccgugggacgugcugcccauggucacccagauggccaugacggacaccacccccuucgggcagcagcgcguguucaaggagaagguggacacccggacgcaggagcccaaggagggcaccaagaagcugaugaagaucaccgcggaguggcucuggaaggagcugggcaagaagaagaccccgcgcaugugcacgcgggaggaguucacccgcaagguccgguccaacgccgcccugggggccaucuucaccgacgagaacaaguggaaguccgcccgcgaggcgguggaggacucccgguucugggagcucgucgacaaggagcgcaaccugcaccuggagggcaagugcgagaccugcguguacaacaugauggggaagcgggagaagaagcucggcgaguucgggaaggccaagggcagccgcgccaucugguacauguggcugggcgcccgguuccuggaguucgaggcccucggguuccugaacgaggaccacugguucucccgcgagaacagccuguccggcguggagggggagggccuccacaagcugggguacauccugcgggacgucagcaagaaggagggcggcgcgauguacgccgacgacacggccgggugggacacccgcaucacccucgaggaccugaagaacgaggagauggugaccaaccacauggagggcgagcacaagaagcuggccgaggcgaucuucaagcucacguaccagaacaaggugguccgggugcagcgccccacgccccgggggaccgugauggacaucaucagccgccgggaccagcgcggcuccgggcaggucggcaccuacggccugaacacguucaccaacauggaggcccagcugauccggcagauggagggggagggcguguucaagaacauccagcaccucaccgugaccgaggaggucgccgugaagaacuggcuggcccgcguggggcgcgagcggcugagccgcauggccaucuccggcgacgacugcgucgugaagccccucgacgaccgguucgcgaacgcccugacggcccugaacgacaugggcaagauccgcaaggacauccagcagugggagccgagcaagggguggaacgacuggacccaggugcccuucugcucccaccacuuccacgagcucaucaugaaggacggccggguccugguggugcccugccgcaaccaggacgagcugaucgggcgggcccgcaucagccagggcgccggguggucccuccgggagaccgcgugccugggcaagagcuacgcccagauguggucccugauguacuuccaccgccgggaccuccgccuggccgccaacgccaucugcagcgcgguccccucccacugggugccgaccagccggacgaccugguccauccacgccaagcacgaguggaugaccaccgaggacaugcugaccguguggaaccgcgucuggauccgggagaaccccuggauggaggacaagacgcccguggagagcugggaggagauccccuaccucggcaagcgcgaggaccaguggugcgggucccugaucggccugaccagccgggccaccugggccaagaacauccaggccgcgaucaaccaggugcgcucccucaucgggaacgaggaguacaccgacuacaugccgagcaugaagcgguuccgccgcgaggaggaggaggccggcguccugugguga

SEQ ID NO: 9543 - RNA, 9876 nt, Artificial Sequence
  derived and/or modified CDS sequence (opt1) from DENV-2__FJ410223__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacgcggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggcgcaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggccaucauggcggucggcaugguguccauccuggccagcucccuccugaagaacgacauccccaugaccggcccccugguggccgggggccuccugaccgucugcuacgugcugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgucaucuccggccuguucccgaucagcauccccaucaccgccgccgccugguaccugugggaggugaagaagcagcgcgccggggugcucugggacguccccagcccgccgcccaugggcaaggcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgguccggcgccuacgugagcgccaucgcgcagaccgagaaguccaucgaggacaaccccgagaucgaggacgacaucuuccgcaagaagcggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucgcccugcuggccaccgugaccgggggcaucuuccucuuccugaugagcggccgcgggaucggcaagaugacccuggggaugugcugcaucaucaccgcguccauccuccugugguacgcccagauccagccgcacuggaucgccgccagcaucauccuggaguucuuccucaucgugcugcugauccccgagcccgagaagcagcggacgccccaggacaaccagcucaccuacgucgugaucgccauccugacgguggucgcggccaccauggccaacgagaugggcuuccuggagaagaccaagaaggaccucgggcugggcuccaucgccacccagcagccggagagcaacauccuggacaucgaccuccgccccgccuccgcguggacgcuguacgccguggccaccaccuucgugacccccaugcugcggcacagcaucgagaacagcuccgucaacgugagccucacggccaucgccaaccaggcgaccgugcugaugggccuggggaagggcuggccccucuccaagauggacaucggggucccgcugcuggccaucggcugcuacagccaggugaaccccaucacccucaccgccgcccugcugcuccugguggcgcacuacgccaucaucgggcccggccugcaggccaaggccacgcgcgaggcccagaagcgggcggccgccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcacgaccugggcccucugcgaggcccugacccuggcgaccgggcccaucuccacgcucugggagggcaacccggggcgguucuggaacaccaccaucgccgugagcauggccaacaucuuccgcggcuccuaccuggccggcgccgggcuccucuucagcaucaugaagaacaccacgaacacccggcgcggcaccgggaacaugggcgagacccugggcgagaaguggaagucccgccugaacgcgcucgggaaguccgaguuccagaucuacaagaaguccggcauccaggaggucgaccggacgcuggccaaggaggggaucaagcgcggcgagaccgaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugaccaagggcgggcccggccacgaggagcccaucccgauguccacguacggguggaaccucgugcgccugcagagcggcgucgacguguucuucaucccgcccgagaagugcgacacccugcucugcgacaucggggaguccagccccaacccgaccguggaggcgggccggacccugcgcguccugaaccucguggagaacuggcugaacaacaacacgcaguucugcaucaaggugcugaaccccuacaugcccuccgucaucgagaagauggaggcccugcagcggaaguacggcggggcccucgugcgcaacccgcugagcggcaaccugaagaacgagauguacugggugagcaacgccuccgggaacaucgucagcuccgugaacaugaucagccggaugcucaucaaccgcuucaccaugcggcacaagaaggccaccuacgagcccgacguggaccugggcuccgggacccgcaacaucggcaucgagagcgagacccccaaccuggacaucaucggcaagcggaucgagaagaucaagcaggagcacgagacguccuggcacuacgaccaggaccaccccuacaagaccugggcguaccacgggagcuacgagaccaagcagaccggcuccgccagcuccauggucaacgggguggugcgccuccugacgaagccgugggacguccugcccaccgugacccagauggccaugaccgacacgacccccuucggccagcagcggguguucaaggagaaggucgacacccgcacccaggagcccaaggagggcacgaagaagcucaugaagaucaccgccgaguggcuguggaaggagcuggggaagaagaagaccccgcgcaugugcacccgggaggaguucacgcgcaaggugcggagcaacgccgcgcucggcgccaucuucaccgacgagaacaaguggaaguccgcccgcgaggccguggaggacagccgguucugggagcuggucgacaaggagcgcaaccugcaccucgaggggaagugcgagaccugcguguacaacaugaugggcaagcgggagaagaagcugggggaguucggcaaggccaagggcucccgcgcgaucugguacauguggcugggggcccgguuccucgaguucgaggcccugggcuuccugaacgaggaccacugguucagccgcgagaacucccucagcggggucgagggcgaggggcugcacaagcugggcuacauccuccgggacguguccaagaaggagggcggggccauguacgcggacgacaccgccggcugggacacgcgcaucacccuggaggaccugaagaacgaggagauggugaccaaccacauggagggggagcacaagaagcucgccgaggccaucuucaagcugaccuaccagaacaaggucgugcgggugcagcgccccacgccccggggcaccgucauggacaucaucagccgccgggaccagcgcgggagcggccaggugggcaccuacgggcugaacaccuucacgaacauggaggcccagcucauccggcagauggagggcgaggggguguucaagaacauccagcaccugaccgucaccgaggagguggcggugcagaacuggcuggcccgcgucggccgggagcgccucucccgcauggccaucagcggcgacgacugcguggugaagccccuggacgaccgguucgccaacgcccugaccgcgcucaacgacauggggaagauccgcaaggacauccagcagugggagccguccaagggcuggaacgacuggacgcagguccccuucugcagccaccacuuccacgagcugaucaugaaggacgggcgggugcuggugguccccugccgcaaccaggacgagcucaucggccgggcccgcaucucccagggggccggcuggagccugcgggagaccgccugccugggcaaguccuacgcccagauguggagccucauguacuuccaccgccgggaccugcgccugguggcgaacgccaucugcuccgccgugcccagccacugggucccgaccucccggaccacguggagcauccacgccaagcacgaguggaugaccaccgaggacaugcucaccguguggaaccgcguguggauccgggagaaccccuggauggaggacaagacccccgucgaguccugggaggagauccccuaccuggggaagcgcgaggaccaguggugcggcagccugaucgggcucacgucccgggccaccugggcgaagaacauccaggccgccaucaaccaggugcgcagccugaucggcaacgaggaguacaccgacuacaugccguccaugaagcgguuccgccgggaggaggaggaggccggggugcugugguga

SEQ ID NO: 9544 - RNA, 9876 nt, Artificial Sequence
  derived and/or modified CDS sequence (opt1) from DENV-2__FJ410224__SS-prME
agcgcggggaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccgugaccuacaagugcccccuccugcggcagaacgagcccgaggacaucgacugcuggugcaacagcaccagcaccugggucaccuacgggaccugcaccaccaccggcgagcaccgccgggagaagcgcagcguggcccuggugccccacgucgggaugggccucgagacccggaccgagaccuggaugagcagcgagggggccuggaagcacgcccagcgcaucgagaccuggauccugcggcacccgggcuucacgaucauggccgcgauccuggccuacaccaucgggaccacccacuuccagcgcgugcucaucuucauccugcugacggccguggcccccagcaugaccaugcggugcaucggcaucagcaaccgcgacuucgucgagggcguguccgggggcagcuggguggacaucguccucgagcacggguccugcgugaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcauggucgaccgcggcugggggaacggcugcggccuguucggcaagggcgggaucgugacgugcgccauguucacgugcaagaagaacauggagggcaagaucgugcagcccgagaaccuggaguacaccaucgucgugacgccccacuccggggaggagcacgcggugggcaacgacacggggaagcacggcaaggagaucaaggucaccccgcagagcuccaucaccgaggccgagcugaccggguacggcaccgugacgauggagugcagcccccggaccggccucgacuucaacgagauggugcugcugcagauggagaacaaggccuggcucguccaccgccagugguuccuggaccugccccuccccuggcugccgggggccgacaagcaggaguccaacuggauccagaaggagacccuggugaccuucaagaacccccacgccaagaagcaggacgucguggugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaaggucgugaaggagaucgccgagacccagcacggcaccaucgugauccggguccaguacgagggggacggcagccccugcaagauccccuucgagaucauggaccuggagaagcgcuacgugcucggccggcugaucaccgugaacccgaucgucacggagaaggacucccccgugaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcggggucuucacgagcaucggcaaggcccuccaccagguguucggggccaucuacggcgcggccuucuccggcgugagcuggaccaugaagauccugaucggggucaucaucaccuggaucggcaugaacucccggagcaccucccugagcgugucccuggugcucgucgggacggugacccuguaccugggcgugaugguccaggccgacagcgggugcgugguguccuggaaguccaaggagcucaagugcggcagcggcaucuucaucaccgacaacguccacaccuggacggagcaguacaaguuccagcccgagucccccagcaagcuggccuccgcgauccagaaggcccaggaggaggggaucugcggcauccgcagcgugacccggcuggagaaccucauguggaagcagaucacccccgagcugaaccacauccuggccgagaacgaggugaagcucaccaucaugacgggggacaucaagggcaucaugcaggccgggaagcgcucccugcggccgcagcccaccgagcugaaguacagcuggaagaccuggggcaaggccaagaugcucuccaccgagagcuacaaccagacguuccugaucgacggccccgagaccgcggagugcccgaacaccaaccgcgccuggaacucccuggaggucgaggacuacggguucggcguguucaccacgaacaucuggcucaagcugaaggagaagcaggacgccuucugcgacagcaagcugauguccgccgccaucaaggacaaccgggcggugcacgccgacaugggguacuggaucgagagcgcccucaacgacaccuggaagaucgagaaggccuccuucaucgaggucaagaacugccacuggcccaagagccacacccugugguccaacggcgugcuggagagcgagaugaucauccccaagaaccucgccggccccgugucccagcacaacuaccgcccgggguaccacacccagaucgcgggccccuggcaccuggggaagcuggagauggacuucgacuucugcgacggcaccacggucaucgugaccgaggacugcgggaaccggggccccagccuccgcaccaccacggccagcggcaagcugaucaccgaguggugcugccgguccugcacccugcccccgcuccgcuaccgcggggaggacggcugcugguacgggauggagauccgcccccugaaggagaaggaggagaaccuggugaacagccucgucaccgccggccacggccagguggacaacuucucccugggcgugcugggcauggcccucuuccuggaggagaugcugcggacgcgcgucgggaccaagcacgcgauccuccugguggccgugagcuucgucacccugaucaccggcaacauguccuucaaggaccucgggcgggugguggucauggugggcgccacgauggccgacgacaucgggaugggcgugaccuaccuggcccugcucgcggccuucaagguccgccccaccuucgccgccggccugcugcuccggaagcugaccagcaaggagcugaugaugacgaccaucgggaucgugcuccugucccagagcaccauccccgagaccgugcuggagcucacggacgcccuggcgcugggcaugaugguccucaagaucgugcgcaacauggagaaguaccagcuggccgucaccaucauggccauccugugcgugccgaacgccgugauccuccagaacgccuggaaggucuccugcaccauccuggcgguggugagcgucagcccccugcuccugaccagcucccagcagaagacggacuggaucccccuggcccucaccaucaaggggcugaaccccaccgccaucuuccugaccacgcucagccgcaccaacaagaagcgguccuggccgcugaacgaggccaucauggcggugggcauggugagcauccuggccuccagccuccugaagaacgacauccccaugaccggcccccuggucgccgggggccuccugaccgugugcuacgugcugacggggcgcuccgccgaccucgagcuggagcgggccaccgacgucaagugggaggaccaggcggagaucagcggcagcucccccauccugagcaucaccaucuccgaggacgggagcauguccaucaagaacgaggaggaggagcagacccucacgauccugauccgcaccggccugcucgugaucagcggccuguucccgaucuccauccccaucaccgccgccgccugguaccugugggaggugaagaagcagcgggccgggguccucugggacgugcccagcccgccgcccaugggcaaggcggagcuggaggacggggccuaccgcaucaagcagaagggcauccugggguacucccagaucggcgccggcguguacaaggaggggaccuuccacaccauguggcacgucacgcggggcgccgugcucaugcacaaggggaagcgcaucgagcccagcugggccgacgugaagaaggaccugaucuccuacggcgggggcuggaagcuggagggcgaguggaaggagggggaggagguccaggugcucgcgcuggagcccggcaagaacccccgggccgugcagaccaagcccgggcuguucaagaccaacaccggcacgaucggggccgucagccucgacuucucccccggcaccagcggcucccccaucaucgacaagaaggggaagguggugggccuguacgggaacggcgucgugacccgcagcggcgccuacguguccgccaucgcgcagaccgagaaguccaucgaggacaaccccgagaucgaggacgacaucuuccggaagcgccggcugacgaucauggaccugcaccccggggccggcaagaccaagcgcuaccuccccgccaucguccgggaggccaucaagcgcgggcugcggacccugauccucgcgccgacccgcgugguggccgccgagauggaggaggcccugcggggccugcccauccgcuaccagacgcccgccauccgggcggagcacaccgggcgcgagaucgucgaccucaugugccacgccaccuucaccaugcgccugcugucccccgugcgggugccgaacuacaaccucaucaucauggacgaggcccacuucacggaccccgccagcaucgccgcgcgcggcuacaucagcacccgggucgagaugggcgaggccgccgggaucuucaugaccgccacgccgcccggcucccgcgacccguucccccagagcaacgcccccaucaucgacgaggagcgggagauccccgagcgcuccuggaacagcgggcacgagugggugacggacuucaagggcaagaccgugugguucgucccguccaucaaggcggggaacgacaucgccgccugccugcggaagaacggcaagaaggugauccagcugagccgcaagaccuucgacuccgaguacgugaagacccggacgaacgacugggacuucgucgugaccaccgacaucagcgagaugggcgccaacuucaaggcggagcgcgugaucgacccccggcgcugcaugaagcccgucauccucaccgacggggaggagcgggugauccuggccggccccaugccggugacgcacuccagcgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgcgagaaggucgacgccaucgacggcgaguaccggcugcgcggggaggcccgcaagaccuucguggaccucaugcggcgcggcgaccugcccguguggcuggccuacaaggucgccgcggaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacagcgacccccucgcccugaaggaguucaaggaguucgccgcgggccgcaagucccugacgcucaaccugaucaccgagaugggccggcugcccaccuucaugacccagaagacgcgcgacgcccucgacaaccuggccgugcugcacaccgccgaggccggcgggcgggccuacaaccacgcccucagcgagcugcccgagacccuggagacccuccugcugcucacgcugcuggccaccgugaccgggggcaucuuccucuuccugauguccggccgcgggaucggcaagaugacccuggggaugugcugcaucaucaccgccagcauccuccugugguacgcgcagauccagccgcacuggaucgccgccuccaucauccuggaguucuuccucaucguccugcugauccccgagcccgagaagcagcggacgccccaggacaaccagcucaccuacguggugaucgccauccugaccgucguggccgcgaccauggccaacgagaugggcuuccuggagaagacgaagaaggaccucgggcugggcagcaucgccacccagcagccggaguccaacauccuggacaucgaccuccgccccgccagcgccuggacccuguacgcgguggccaccacguucgucacccccaugcugcggcacagcaucgagaacuccagcgugaacgugucccucaccgccaucgccaaccaggccaccguccugaugggccuggggaagggcuggccccucagcaagauggacaucggggugccgcugcuggcgaucggcugcuacucccaggugaaccccaucacgcucaccgccgcccugcugcuccuggucgcccacuacgcgaucaucgggcccggccugcaggccaaggccacccgcgaggcccagaagcgggccgcggccggcaucaugaagaaccccaccguggacgggaucacggugaucgaccucgacccgauccccuacgaccccaaguucgagaagcagcugggccaggucaugcugcucauccugugcgugacccaggugcugaugaugcgcaccaccugggcccucugcgaggcccugacgcuggccaccgggcccaucagcacccucugggagggcaacccggggcgguucuggaacaccacgaucgcggucuccauggccaacaucuuccgcggcagcuaccuggccggcgccgggcuccucuucuccaucaugaagaacaccaccaacacccggcgcggcacggggaacaucggcgagacccugggcgagaaguggaagucccgccugaacgcccucgggaaguccgaguuccagaccuacaagaaguccggcauccaggagguggaccggacccuggcgaaggaggggaucaagcgcggcgagacggaccaccacgccgugucccgggggagcgccaagcugcgcugguucgucgagcggaacauggugacccccgagggcaagguggucgaccucggcugcgggcgcggcgggugguccuacuacugcggcgggcugaagaacgugcgggaggugaagggccugaccaagggcgggcccggccacgaggagcccaucccgaugagcaccuacggguggaaccucguccgccugcaguccggcguggacguguucuucaucccgcccgagaagugcgacacgcugcucugcgacaucggggagagcucccccaacccgaccgucgaggccggccggacccugcgcgugcugaaccucguggagaacuggcugaacaacaacacccaguucugcaucaagguccugaaccccuacaugcccagcgugaucgagaagauggaggcgcugcagcggaaguacggcggggcccucgugcgcaacccgcugagccggaacuccacccacgagauguacugggucagcaacgccuccggcaacaucgugagcuccgugaacaugaucagccgcaugcugaucaaccgguucacgaugcgccacaagaaggccaccuacgagcccgacgucgaccucggguccggcacccggaacaucgggaucgagagcgagauccccaaccuggacaucaucggcaagcgcaucgagaagaucaagcaggagcacgagaccuccuggcacuacgaccaggaccaccccuacaagacgugggccuaccacggcagcuacgagaccaagcagaccggguccgcgagcuccauggugaacggcgugguccggcugcucaccaagccgugggacgugcugcccacggugacccagauggccaugaccgacaccacgcccuucgggcagcagcgcgucuucaaggagaagguggacacccgcacccaggagcccaaggagggcaccaagaagcugaugaagaucacggccgaguggcucuggaaggagcugggcaagaagaagaccccgcggaugugcacccgcgaggaguucacccggaaggugcgcagcaacgccgcccugggggcgaucuucacggacgagaacaaguggaaguccgcccgggaggccgucgaggacagccgcuucugggagcucguggacaaggagcggaaccugcaccuggagggcaagugcgagaccugcgucuacaacaugauggggaagcgcgagaagaagcucggcgaguucgggaaggccaagggcucccgggccaucugguacauguggcugggcgcgcgcuuccuggaguucgaggcccucggguuccugaacgaggaccacugguucagccgggagaacucccugagcggcguggagggggagggccuccacaagcugggguacauccugcgcgacgugagcaagaaggagggcggcgccauguacgccgacgacaccgcggggugggacacccggaucacgcucgaggaccugaagaacgaggagauggucaccaaccacauggagggcgagcacaagaagcuggccgaggccaucuucaagcucaccuaccagaacaagguggugcgcguccagcggcccacgccccgggggacggugauggacaucaucucccggcgcgaccagcggggcagcggccagguggggaccuacggccugaacaccuucaccaacauggaggcccagcugauccgccagauggagggggagggcgucuucaagaacauccagcaccucacggugaccgaggagguggccguccagaacuggcuggcgcggguggggcgcgagcgccugucccggauggccaucagcggcgacgacugcguggucaagccccucgacgaccgcuucgccaacgcccugaccgcccugaacgacaugggcaagauccggaaggacauccagcagugggagccguccaagggguggaacgacuggacccaggugcccuucugcagccaccacuuccacgagcucaucaugaaggacggccgcgugcuggucgugcccugccggaaccaggacgagcugaucgggcgcgcgcggaucucccagggcgccggguggagccuccgcgagacggccugccugggcaaguccuacgcccagauguggagccugauguacuuccaccggcgcgaccuccggcuggccgcgaacgccaucugcuccgccgugcccagccacugggucccgaccucccgcaccaccuggagcauccacgccaagcacgaguggaugaccacggaggacaugcugaccguguggaaccggguguggauccgcgagaaccccuggauggaggacaagacccccgucgaguccugggaggagauccccuaccucggcaagcgggaggaccaguggugcgggagccugaucggccugaccucccgcgccacgugggcgaagaacauccaggccgccaucaaccaggugcggagccucaucgggaacgaggaguacaccgacuacaugccgagcaugaagcgcuuccggcgcgaggaggaggaggccggcgugcugugguga

SEQ ID NO: 9545 - RNA, 9876 nt, Artificial Sequence
  derived and/or modified CDS sequence (opt1) from DENV-2__FJ461321__SS-prME
agcgccgggaugaucaucaugcugauccccaccgugauggccuuccaccucaccacccggaacggggagccccacaugaucgucgggauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacagcgugggcaacgacacggggaagcacggcauggagaucaaggugaccccgcaguccagcaucaccgaggcggagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggagagcaacuggauccagaaggagacccuggucaccuucaagaacccccacgccaagaagcaggacguggucgugcucggcagccaggagggggccaugcacacggcgcugaccggcgccaccgagauccagauguccagcgggaaccuccuguucaccggccaccugaagugccggcugcgcauggacaagcuccagcugaagggcauguccuacagcaugugcacggggaaguucaagguggucaaggagaucgccgagacccagcacggcaccaucgugauccgggugcaguacgagggggacggcucccccugcaagauccccuucgagaucauggaccuggagaagcgcuacguccucggccggcugaucaccgugaacccgaucgugacggagaaggacagccccgucaacaucgaggccgagccgcccuucggggacuccuacaucaucaucggcguggagccggggcagcugaagcucaacugguucaagaagggcagcuccaucgggcagauguucgagaccaccaugcgcggcgccaagcgcauggcgauccugggcgacaccgccugggacuucgggagccugggcgggguguucacguccaucggcaaggcccuccaccaggucuucggggccaucuacggcgccgcguucagcggcguguccuggaccaugaagauccugaucggggugaucaucaccuggaucggcaugaacagccgguccaccagccuguccgucagccuggugcucguggggaucgucacgcuguaccugggcgugauggugcaggccgacuccgggugcgucgugagcuggaagaacaaggagcucaagugcggcagcggcaucuucaucaccgacaacgugcacaccuggaccgagcaguacaaguuccagcccgagucccccagcaagcuggccuccgccauccagaaggcgcaggaggaggggaucugcggcauccgcagcgucacgcggcuggagaaccucauguggaagcagaucacccccgagcugaaccacauccuggccgagaacgaggugaagcucaccaucaugaccggggacauccgcggcaucaugcaggccgggaagcggucccugcgcccgcagcccacggagcugaaguacagcuggaagaccuggggcaaggccaagaugcucuccaccgagagcuacaaccagaccuuccugaucgacggccccgagacggccgagugcccgaacaccaaccgggcguggaacucccuggagguggaggacuacggguucggcgucuucaccaccaacaucuggcucaagcugaaggagaagcaggacgccuucugcgacagcaagcugauguccgccgccaucaaggacaaccgcgccgugcacgcggacaugggguacuggaucgagagcgcccucaacgacacguggaagaucgagaaggccuccuucaucgaggugaagaacugccacuggcccaagagccacacccugugguccaacggcguccuggagagcgagaugaucauccccaagaaccucgccggccccgugucccagcacaacuaccggccgggguaccacacccagaucgccggccccuggcaccuggggaagcuggagauggacuucgacuucugcgacggcaccaccgugaucgucacggaggacugcgggaaccgcggccccagccuccggaccaccaccgcgagcggcaagcugaucacggaguggugcugccgcuccugcacccugcccccgcuccgguaccgcggggaggacggcugcugguacgggauggagauccggccccugaaggagaaggaggagaaccuggugaacagccucgugaccgccggccacgggcaggucgacaacuucucccugggcgugcugggcauggcccucuuccuggaggagaugcugcgcacccggguggggacgaagcacgccauccuccuggucgcggugagcuucgugacccugaucaccggcaacauguccuucaaggaccucgggcgcgucguggugauggucggcgccaccauggccgacgacaucgggaugggcgugacguaccuggcccugcucgccgcguucaaggugcggcccaccuucgccgccggccugcugcuccgcaagcugaccagcaaggagcugaugaugaccacgaucgggaucguccuccugucccagagcaccauccccgagaccgugcuggagcucaccgacgcccuggcccugggcaugauggugcucaagaucguccgcaacauggagaaguaccagcuggcggugacgaucauggccauccugugcgucccgaacgccgugauccuccagaacgccuggaagguguccugcaccauccuggccgucgugagcgugagcccccugcuccugaccagcucccagcagaagaccgacuggaucccccuggcgcucacgaucaaggggcugaaccccaccgccaucuuccugaccacccucagccggacgaacaagaagcgcuccuggccgcugaacgaggccaucauggccgucggcauggugagcauccuggcguccagccuccugaagaacgacauccccaugaccggcccccugguggccgggggccuccugaccgucugcuacgugcugaccgggcgguccgccgaccucgagcuggagcgcgccacgaacgugaagugggaggaccaggccgagaucagcggcagcucccccauccugagcaucaccaucuccgaggacgggagcauguccaucaagaacgaggaggaggagcagacccucaccauccugauccggacgggccugcucgucaucagcggccuguucccgaucuccauccccaucaccgcggccgccugguaccugugggaggugaagaagcagcgcgccggggugcucugggacguccccuccccgccgcccaugggcaaggccgagcuggaggacggggcguaccggaucaagcagaagggcauccugggguacucccagaucggcgccggcguguacaaggaggggaccuuccacaccauguggcacgugacccgcggcgccguccucaugcacaaggggaagcggaucgagcccagcugggccgacgugaagaaggaccugaucuccuacggcgggggcuggaagcuggagggcgaguggaaggagggggaggaggugcagguccucgcccuggagcccggcaagaacccccgcgcggugcagacgaagcccgggcuguucaagaccaacaccggcaccaucggggccgugagccucgacuucucccccggcacgagcggcucccccaucaucgacaagaaggggaaggucgugggccuguacgggaacggcguggucacccggagcggcgccuacguguccgccaucgcccagaccgagaaguccaucgaggacaaccccgagaucgaggacgacaucuuccgcaagcggcgccugaccaucauggaccugcaccccggggcgggcaagacgaagcgguaccuccccgccaucgugcgcgaggccaucaagcgggggcugcgcacccugauccucgccccgacccgggucguggcggccgagauggaggaggcccugcgcggccugcccauccgguaccagacccccgccauccgcgccgagcacacggggcgcgagaucguggaccucaugugccacgcgaccuucaccaugcggcugcugucccccguccgcgugccgaacuacaaccucaucaucauggacgaggcccacuucaccgaccccgccagcaucgccgcccggggcuacaucagcacgcgcguggagaugggcgaggcggccgggaucuucaugaccgccacgccgcccggcucccgggacccguucccccagagcaacgcccccaucaucgacgaggagcgcgagauccccgagcgguccuggaacagcgggcacgagugggucaccgacuucaagggcaagacggugugguucgugccguccaucaaggccgggaacgacaucgcggccugccugcgcaagaacggcaagaaggucauccagcugagccggaagaccuucgacuccgaguacgugaagacccgcaccaacgacugggacuucguggucacgaccgacaucagcgagaugggcgccaacuucaaggccgagcgggugaucgacccccgccggugcaugaagcccgugauccucaccgacggggaggagcgcgucauccuggcgggccccaugccggugacccacuccagcgccgcccagcggcgcgggcggaucggccgcaaccccaagaacgagaacgaccaguacaucuacaugggggagccccuggaguccgacgaggacugcgcccacuggaaggaggccaagaugcuccuggacaacaucaacacgcccgagggcaucaucccgagcauguucgagcccgagcgggagaagguggacgcgaucgacggcgaguaccgccugcgcggggaggcccggaagaccuucgucgaccucaugcgccggggcgaccugcccguguggcuggccuacaagguggccgccgaggggaucaacuacgcggaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgccggccgcaagagccugacccucaaccugaucacggagaugggccgccugcccaccuucaugacccagaagacccgggacgcgcucgacaaccuggccguccugcacacggccgaggccgggggccgcgcguacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcgcacgccccaggacaaccagcucacguacgucgugaucgccauccugaccguggucgccgccaccauggcgaacgagaugggcuuccuggagaagaccaagaaggaccucgggcugggcuccaucgccacgcagcagccggagagcaacauccuggacaucgaccuccggcccgccagcgccuggacccuguacgccguggcgaccaccuucgugacgcccaugcugcgccacuccaucgagaacagcuccgucaacgugagccucaccgccaucgccaaccaggccaccgugcugaugggccuggggaagggcuggccccucuccaagauggacaucggggucccgcugcuggccaucggcugcuacagccaggugaaccccaucacccucacggcggcccugcugcuccugguggcccacuacgccaucaucgggcccggccugcaggcgaaggccacccgggaggcccagaagcgcgccgccgcgggcaucaugaagaaccccaccgucgacgggaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacggggcccaucuccacccucugggagggcaacccggggcgcuucuggaacaccaccaucgccgugagcauggcgaacaucuuccggggcuccuaccuggccggcgccgggcuccucuucagcaucaugaagaacacgaccaacacccgccgcggcaccgggaacaucggcgagacgcugggcgagaaguggaagucccggcugaacgcccucggcaagagcgaguuccagaucuacaagaaguccggcauccaggaggucgaccgcacccuggccaaggaggggaucaagcggggcgagaccgaccaccacgcggugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugacgaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgaccguggaggccggccgcacgcugcggguccugaaccucguggagaacuggcugaacaacaacacccaguucugcaucaaggugcugaaccccuacaugcccagcgucaucgagaagauggaggcccugcagcgcaaguacggcggggcgcucgugcggaacccgcugucccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgccuccagcauggucaacggcguggugcgccugcucaccaagccgugggacguccugcccaccgugacccagauggcgaugacggacaccacccccuucgggcagcagcgcguguucaaggagaaggucgacacccggacgcaggagcccaaggagggcaccaagaagcugaugaagaucaccgccgaguggcucuggaaggagcugggcaagaagaagaccccgcgcaugugcacgcgggaggaguucacccgcaaggugcgguccaacgccgcccugggggccaucuucaccgacgagaacaaguggaaguccgcgcgcgaggccguggaggacucccgguucugggagcucgucgacaaggagcgcaaccugcaccuggagggcaagugcgagaccugcguguacaacaugauggggaagcgggagaagaagcucggcgaguucgggaaggccaagggcagccgcgccaucugguacauguggcugggcgcccgguuccuggaguucgaggcgcucggguuccugaacgaggaccacugguucucccgcgagaacagccugagcggcgucgagggggagggccuccacaagcugggguacauccugcgggacguguccaagaaggagggcggcgccauguacgccgacgacacggccgggugggacacccgcaucacccucgaggaccugaagaacgaggagauggugaccaaccacauggagggcgagcacaagaagcuggcggaggccaucuucaagcucacguaccagaacaaggucgugcgggugcagcgccccacgccccgggggaccgucauggacaucaucagccgccgggaccagcgcggcuccggccaggugggcaccuacggccugaacacguucaccaacauggaggcccagcugauccggcagauggagggggagggcguguucaagaacauccagcaccucaccgucaccgaggagguggccgugcacaacuggcuggcccgcgucgggcgcgagcggcugagccgcauggcgaucuccggcgacgacugcguggugaagccccucgacgaccgguucgccaacgcccugacggcccugaacgacaugggcaagauccgcaaggacauccagcagugggagccgagcaagggguggaacgacuggacccagguccccuucugcucccaccacuuccacgagcucaucaugaaggacggccggauccugguggugcccugccgcaaccaggacgagcugaucgggcgggcccgcaucagccagggcgcgggguggucccuccgggagaccgccugccugggcaagagcuacgcccagauguggucccugauguacuuccaccgccgggaccuccgccuggccgccaacgcgaucugcagcgccguccccucccacugggugccgaccagccggacgaccugguccauccacgccaagcacgaguggaugaccaccgaggacaugcugaccguguggaaccgcgucuggauccgggagaaccccuggauggaggacaagacgcccguggagagcugggaggagauccccuaccucggcaagcgcgaggaccaguggugcgggucccugaucggccugaccagccgggccaccugggccaagaacauccaggcggccaucaaccaggugcgcagccucaucgggaacgaggaguacaccgacuacaugccguccaugaagcgguuccgccgcgaggaggaggaggccggcguccugugguga

SEQ ID NO: 9546 - RNA, 9876 nt, Artificial Sequence
  derived and/or modified CDS sequence (opt1) from DENV-2__FJ410228__SS-prME
agcgcggggaugaucaucaugcugauccccaccgugauggccuuccaccucaccacccgcaacggggagccccacaugaucgucgggauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacauccgcggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggccaucauggcggucggcaugguguccauccuggccagcucccuccugaagaacgacauccccaugaccggcccccugguggccgggggccuccugaccgucugcuacgugcugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgucaucuccggccuguucccgaucagcauccccaucaccgccgccgccugguaccugugggaggugaagaagcagcgcgccggggugcucugggacguccccagcccgccgcccaugggcaaggcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccgggucguggccgccgagauggaggaggcccugcgcggccugcccauccgguaccagacccccgccauccgcgcggagcacacggggcgcgagaucguggaccucaugugccacgccaccuucaccaugcggcugcugagccccguccgcgugccgaacuacaaccucaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggucaccgacuucaacggcaagacggugugguucgugccgagcaucaaggcggggaacgacaucgccgccugccugcgcaagaacggcaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccucaccgacggggaggagcgcgucauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaagguggacgccaucgacggcgaguaccgccugcgcggggaggcccggaagaccuucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccguccugcacacggccgaggccggcgggcgcgccuacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccggcccgccuccgccuggacccuguacgcgguggccaccaccuucgugacgcccaugcugcgccacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgggaggcccagaagcgcgccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacggggcccaucuccacccucugggagggcaacccggggcgcuucuggaacaccaccaucgcggugagcauggccaacaucuuccggggcuccuaccuggccggcgccgggcuccucuucagcaucaugaagaacacgaccaacacccgccgcggcaccgggaacaucggcgagacgcugggcgagaaguggaagucccggcugaacgcccucggcaagagcgaguuccagaucuacaagaaguccggcauccaggaggucgaccgcacccuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugacgaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgaccguggaggccggccgcacgcugcggguccugaaccucguggagaacuggcugaacaacaacacccaguucugcaucaaggugcugaaccccuacaugcccuccgucaucgagaagauggaggcgcugcagcgcaaguacggcggggcccucgugcggaacccgcugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgcguccagcauggucaacggcguggugcgccugcucaccaagccgugggacguccugcccaccgugacccagauggccaugacggacaccacccccuucgggcagcagcgcguguucaaggagaaggucgacacccggacgcaggagcccaaggagggcaccaagaagcugaugaagaucaccgccgaguggcucuggaaggagcugggcaagaagaagaccccgcgcaugugcacgcgggaggaguucacccgcaaggugcgguccaacgccgcccugggggcgaucuucaccgacgagaacaaguggaaguccgcccgcgaggccguggaggacucccgguucugggagcucgucgacaaggagcgcaaccugcaccuggagggcaagugcgagaccugcguguacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcgucgagggggagggccuccacaagcugggguacauccugcgggacgugagcaagaaggagggcggcgccauguacgccgacgacacggcggggugggacacccgcaucacccucgaggaccugaagaacgaggagauggugaccaaccacauggagggcgagcacaagaagcuggccgaggccaucuucaagcucacguaccagaacaaggucgugcgggugcagcgccccacgccccgggggaccgucauggacaucaucagccgccgggaccagcgcggcuccggccaggugggcaccuacggccugaacacguucaccaacauggaggcccagcugauccggcagauggagggggagggcguguucaagaacauccagcaccucaccgucaccgaggagguggccgugcacaacuggcuggcgcgcgucgggcgcgagcggcugagccgcauggccaucuccggcgacgacugcguggugaagccccucgacgaccgguucgccaacgcccugacggcccugaacgacaugggcaagauccgcaaggacauccagcagugggagccgagcaagggguggaacgacuggacccagguccccuucugcucccaccacuuccacgagcucaucaugaaggacggccggauccugguggugcccugccgcaaccaggacgagcugaucgggcgggcgcgcaucagccagggcgccggguggucccuccgggagaccgccugccugggcaagagcuacgcccagauguggucccugauguacuuccaccgccgggaccuccgccuggccgcgaacgccaucugcagcgccguccccucccacugggugccgaccagccggacgaccugguccauccacgccaagcacgaguggaugaccaccgaggacaugcugaccguguggaaccgcgucuggauccgggagaaccccuggauggaggacaagacgcccguggagagcugggaggagauccccuaccucggcaagcgcgaggaccaguggugcgggucccugaucggccugaccagccgggccaccugggcgaagaacauccaggccgccaucaaccaggugcgcucccucaucgggaacgaggaguacaccgacuacaugccgagcaugaagcgguuccgccgcgaggaggaggaggccggcguccugugguga

SEQ ID NO: 9547 - RNA, 9876 nt, Artificial Sequence
  derived and/or modified CDS sequence (opt1) from DENV-2__FJ410233__SS-prME
agcgccgggaugaucaucaugcugauccccaccgugauggccuuccaccucaccacccggaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucaacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccaugacggacgacaucgggaugggcgugaccuaccuggcccugcucgccgcguucaaggugcgccccaccuucgccgccggccugcugcuccggaagcugaccuccaaggagcugaugaugacgaccaucgggaucguccuccugagccaguccaccauccccgagaccgugcuggagcucacggacgcccuggcccugggcaugauggugcucaagaucguccgcaacauggagaaguaccagcuggcggugaccaucauggccauccugugcgucccgaacgccgugauccuccagaacgccuggaaggugagcugcaccauccuggccgucguguccgugagcccccugcuccugaccuccagccagcagaagacggacuggaucccccuggcgcucaccaucaaggggcugaaccccaccgccaucuuccugaccacgcucucccgcaccaacaagaagcggagcuggccgcugaacgaggccaucauggccgucggcaugguguccauccuggcgagcucccuccugaagaacgacauccccaugaccggcccccugguggccgggggccuccugaccgucugcuacgugcugacggggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacccucacgauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguacaaggaggggaccuuccacaccauguggcacgugacgcggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgcuccggcgccuacgugagcgccaucgcccagaccgagaaguccaucgaggacaaccccgagaucgaggacgacaucuuccggaagcgccggcugacgaucauggaccugcaccccggggcgggcaagaccaagcgcuaccuccccgccaucgugcgggaggccaucaagcgcgggcugcggacccugauccucgccccgacccgcgucguggcggccgagauggaggaggcccugcggggccugcccauccgcuaccagacgcccgccauccgggccgagcacaccgggcgcgagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggcgaggcggccgggaucuucaugaccgccacgccgcccggcagccgcgacccguucccccaguccaacgcccccaucaucgacgaggagcgggagauccccgagcgcagcuggaacuccgggcacgagugggucacggacuucaagggcaagaccgugugguucgugccgagcaucaaggccgggaacgacaucgcggccugccugcggaagaacggcaagaaggucauccagcugucccgcaagaccuucgacagcgaguacgugaagacccggacgaacgacugggacuucguggucaccaccgacaucuccgagaugggcgccaacuucaaggccgagcgcgugaucgacccccggcgcugcaugaagcccgugauccucaccgacggggaggagcgggucauccuggcgggccccaugccggugacgcacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgcgaucgacggcgaguaccggcugcgcggggaggcccgcaagaccuucgucgaccucaugcggcgcggcgaccugcccguguggcuggccuacaagguggccgccgaggggaucaacuacgcggaccggcgcuggugcuucgacggcaucaagaacaaccagauccucgaggagaacauggaggucgagaucuggaccaaggagggggagcggaagaagcugaagccgcgcuggcuggacgcccggaucuacuccgacccccucgcccugaaggaguucaaggaguucgccgccggccgcaagagccugacgcucaaccugaucaccgagaugggccggcugcccaccuucaugacccagaagacgcgcgacgcgcucgacaaccuggccgugcugcacaccgccgaggccgggggccgggcguacaaccacgcccucuccgagcugcccgagacccuggagacccuccugcugcucacgcugcuggccaccgucaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacguggucaucgccauccugaccgugguggccgccaccauggcgaacgagaugggcuuccuggagaagacgaagaaggaccucgggcugggcuccaucgccacccgccagccggagagcaacauccuggacaucgaccuccggcccgccuccgccuggacccuguacgccgucgcgaccacguucgugacccccaugcugcgccacagcaucgagaacagcuccgugaacgucagccucaccgccaucgccaaccaggccaccgugcugaugggccuggggaagggcuggccccucuccaagauggacaucggggugccgcugcuggccaucggcugcuacagccaggucaaccccaucacgcucaccgcggcccugcugcuccugguggcccacuacgccaucaucgggcccggccugcaggcgaaggccacccgggaggcccagaagcgcgccgccgcgggcaucaugaagaaccccaccguggacgggaucacggucaucgaccucgacccgauccccuacgaccccaaguucgagaagcagcugggccaggugaugcugcucgugcugugcgucacccaggugcugaugaugcggaccaccugggcccucugcgaggcccugacgcuggccaccgggcccaucuccacccucugggagggcaacccggggcgcuucuggaacaccacgaucgccgugagcauggcgaacaucuuccggggcuccuaccuggccggcgccgggcuccucuucagcaucaugaagaacaccaccaacacccgccgcggcacggggaacaugggcgagacccugggcgagaaguggaagucccggcugaacgcccucgggaaguccgaguuccagaucuacaagaaguccggcauccaggaggucgaccgcacccuggccaaggaggggaucaagcggggcgagaccgaccaccacgcggugagccgcggguccgccaagcugcggugguucguggagcgcaacauggucacgcccgagggcaaggugguggaccucggcugcgggcggggcggguggagcuacuacugcggcgggcugaagaacguccgcgaggugaagggccugaccaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgacgguggaggccggccgcacccugcggguccugaaccucguggagaacuggcugaacaacaacacccaguucugcaucaaggugcugaaccccuacaugcccuccgucaucgagaagauggaggcccugcagcgcaaguacggcggggcgcucgugcggaacccgcugagccgcaacagcacccacgagauguacuggguguccaacgccagcggcaacaucgucuccagcgugaacaugaucucccggaugcugaucaaccgcuucaccaugcggcacaagaaggccacguacgagcccgacguggaccucgggagcggcacccgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggucaacggcguggugcgccugcucaccaagccgugggacguccugcccaccgugacgcagauggcgaugaccgacaccacccccuucgggcagcagcgcguguucaaggagaaggucgacacgcggacccaggagcccaaggagggcaccaagaagcugaugaagaucaccgccgaguggcucuggaaggagcugggcaagaagaagacgccgcgcaugugcacccgggaggaguucacccgcaaggugcgguccaacgccgcccugggggccaucuucaccgacgagaacaaguggaaguccgcgcgcgaggccguggaggacucccgguucugggagcucgucgacaaggagcgcaaccugcaccuggagggcaagugcgagacgugcguguacaacaugauggggaagcgggagaagaagcucggcgaguucgggaaggccaagggcagccgcgccaucugguacauguggcugggcgcccgguuccuggaguucgaggcgcucggguuccugaacgaggaccacugguucucccgcgagaacagccuguccggcgucgagggggagggccuccacaagcugggguacauccugcgggacgugagcaagaaggagggcggcgccauguacgccgacgacaccgccgggugggacacccgcaucacccucgaggaccugaagaacgaggagauggugacgaaccacauggagggcgagcacaagaagcuggcggaggccaucuucaagcucaccuaccagaacaaggucgugcgggugcagcgccccacgccccgggggaccgucauggacaucaucagccgccgggaccagcgcggcuccggccagguggggacguacggccugaacaccuucaccaacauggaggcccagcugauccggcagauggagggggagggcguguucaagaacauccagcaccucaccgucacggaggagguggccgugaagaacuggcuggcccgcgucgggcgcgagcggcugagccgcauggcgaucuccggcgacgacugcguggugaagccccucgacgaccgguucgccaacgcccugaccgcccugaacgacaugggcaagauccgcaaggacauccagcagugggagccgagcaagggguggaacgacuggacccagguccccuucugcucccaccacuuccacgagcucaucaugaaggacggccgggugcuggugguccccugccgcaaccaggacgagcugaucgggcgggcccgcaucagccagggcgcgggguggucccuccgggagaccgccugccugggcaagagcuacgcccagauguggucccugauguacuuccaccgccgggaccuccgccuggccgccaacgcgaucugcagcgccgugcccucccacugggugccgacgagccggaccaccugguccauccacgccaagcacgaguggaugaccaccgaggacaugcugacggucuggaaccgcguguggauccgggagaaccccuggauggaggacaagacccccguggagagcugggaggagauccccuaccucggcaagcgcgaggaccaguggugcgggucccugaucggccugaccagccgggccaccugggccaagaacauccaggcggccaucaaccagguccgcucccucaucgggaacgaggaguacacggacuacaugccgagcaugaagcgguuccgccgcgaggaggaggaggccggcgugcugugguga

SEQ ID NO: 9548 - RNA, 9876 nt, Artificial Sequence
  derived and/or modified CDS sequence (opt1) from DENV-2__FJ410237__SS-prME
agcgccgggaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccaugacggacgacaucgggaugggcgugaccuaccuggcccugcucgccgcguucaaggugcgccccaccuucgccgccggccugcugcuccggaagcugaccuccaaggagcugaugaugacgaccaucgggaucguccuccugagccaguccaccauccccgagaccgugcuggagcucacggacgcccuggcccugggcaugauggugcucaagaucguccgcaacauggagaaguaccagcuggcggugaccaucauggccauccugugcgucccgaacgccgugauccuccagaacgccuggaaggugagcugcaccauccuggccgucguguccgugagcccccugcuccugaccuccagccagcagaagacggacuggaucccccuggcgcucaccaucaaggggcugaaccccaccgccaucuuccugaccacgcucucccgcaccaacaagaagcggagcuggccgcugaacgaggccaucauggccgucggcaugguguccauccuggcgagcucccuccugaagaacgacauccccaugaccggcccccugguggccgggggccuccugaccgucugcuacgugcugacggggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacccucacgauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguacaaggaggggaccuuccacaccauguggcacgugacgcggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgcuccggcgccuacgugagcgccaucgcccagaccgagaaguccaucgaggacaaccccgagaucgaggacgacaucuuccggaagcgccggcugacgaucauggaccugcaccccggggcgggcaagaccaagcgcuaccuccccgccaucgugcgggaggccaucaagcgcgggcugcggacccugauccucgccccgacccgcgucguggcggccgagauggaggaggcccugcggggccugcccauccgcuaccagacgcccgccauccgggccgagcacaccgggcgcgagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggcgaggcggccgggaucuucaugaccgccacgccgcccggcagccgcgacccguucccccaguccaacgcccccaucaucgacgaggagcgggagauccccgagcgcagcuggaacuccgggcacgagugggucacggacuucaagggcaagaccgugugguucgugccgagcaucaaggccgggaacgacaucgcggccugccugcggaagaacggcaagaaggucauccagcugucccgcaagaccuucgacagcgaguacgugaagacccggacgaacgacugggacuucguggucaccaccgacaucuccgagaugggcgccaacuucaaggccgagcgcgugaucgacccccggcgcugcaugaagcccgugauccucaccgacggggaggagcgggucauccuggcgggccccaugccggugacgcacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgcgaucgacggcgaguaccggcugcgcggggaggcccgcaagaccuucgucgaccucaugcggcgcggcgaccugcccguguggcuggccuacaagguggccgccgaggggaucaacuacgcggaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgccggccgcaagagccugacgcucaaccugaucaccgagaugggccggcugcccaccuucaugacccagaagacgcgcgacgcgcucgacaaccuggccguccugcacaccgccgaggccgggggccgggcguacaaccacgcccucuccgagcugcccgagacccuggagacccuccugcugcucacgcugcuggccaccgugaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugaccguggucgccgccaccauggcgaacgagaugggcuuccuggagaagacgaagaaggaccucgggcugggcuccaucgccacccagcagccggagagcaacauccuggacaucgaccuccgccccgccuccgccuggacccuguacgccguggcgaccacguucgugacccccaugcugcggcacagcaucgagaacagcuccgucaacgugagccucaccgccaucgccaaccaggccaccgugcugaugggccuggggaagggcuggccccucuccaagauggacaucggggucccgcugcuggccaucggcugcuacagccaggugaaccccaucacgcucaccgcggcccugcugcuccugguggcccacuacgccaucaucgggcccggccugcaggcgaaggccacccgcgaggcccagaagcgggccgccgcgggcaucaugaagaaccccaccgucgacgggaucacggugaucgaccucgacccgauccccuacgaccccaaguucgagaagcagcugggccaggugaugcugcucauccugugcgucacccaggugcugaugaugcgcaccaccugggcccucugcgaggcccugacgcuggccaccgggcccaucuccacccucugggagggcaacccggggcgguucuggaacaccacgaucgccgugagcauggcgaacaucuuccgcggcuccuaccuggccggcgccgggcuccucuucagcaucaugaagaacaccaccaacacccggcgcggcacggggaacaugggcgagacccugggcgagaaguggaagucccgccugaacgcccucgggaaguccgaguuccagaucuacaagaaguccggcauccaggaggucgaccggacccuggccaaggaggggaucaagcgcggcgagaccgaccaccacgcggugagccggggguccgccaagcugcgcugguucguggagcggaacauggucacgcccgagggcaaggugguggaccucggcugcgggcgcggcggguggagcuacuacugcggcgggcugaagaacguccgggaggugaagggccugaccaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgacgguggaggccggccggacccugcgcguccugaaccucguggagaacuggcugaacaacaacacccaguucugcaucaaggugcugaaccccuacaugcccuccgucaucgagaagauggaggcccugcagcggaaguacggcggggcgcucgugcgcaacccgcugagccggaacagcacccacgagauguacuggguguccaacgccagcggcaacaucgucuccagcgugaacaugaucucccgcaugcugaucaaccgguucaccaugcgccacaagaaggccacguacgagcccgacguggaccucgggagcggcacccggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggucaacggcguggugcggcugcucaccaagccgugggacguccugcccaccgugacgcagauggcgaugaccgacaccacccccuucgggcagcagcgcguguucaaggagaaggucgacacgcgcacccaggagcccaaggagggcaccaagaagcugaugaagaucaccgccgaguggcucuggaaggagcugggcaagaagaagacgccgcggaugugcacccgcgaggaguucacccggaaggugcgcuccaacgccgcccugggggccaucuucaccgacgagaacaaguggaaguccgcgcgggaggccguggaggacucccgcuucugggagcucgucgacaaggagcggaaccugcaccuggagggcaagugcgagacgugcguguacaacaugauggggaagcgcgagaagaagcucggcgaguucgggaaggccaagggcagccgggccaucugguacauguggcugggcgcccgcuuccuggaguucgaggcgcucggguuccugaacgaggaccacugguucucccgggagaacagccuguccggcgucgagggggagggccuccacaagcugggguacauccugcgcgacgugagcaagaaggagggcggcgccauguacgccgacgacaccgccgggugggacacccggaucacccucgaggaccugaagaacgaggagauggugacgaaccacauggagggcgagcacaagaagcuggcggaggccaucuucaagcucaccuaccagaacaaggucgugcgcgugcagcggcccacgccccgggggaccgucauggacaucaucagccggcgcgaccagcggggcuccggccagguggggacguacggccugaacaccuucaccaacauggaggcccagcugauccgccagauggagggggagggcguguucaagaacauccagcaccucaccgucacggaggagguggccgugaagaacuggcuggcccgggucgggcgcgagcgccugagccggauggcgaucuccggcgacgacugcguggugaagccccucgacgaccgcuucgccaacgcccugaccgcccugaacgacaugggcaagauccggaaggacauccagcagugggagccgagcaagggguggaucgacuggacccagguccccuucugcucccaccacuuccacgagcucaucaugaaggacggccgcgugcuggugguccccugccggaaccaggacgagcugaucgggcgcgcccggaucagccagggcgcgggguggucccuccgcgagaccgccugccugggcaagagcuacgcccagauguggucccugauguacuuccaccggcgcgaccuccggcuggccgccaacgcgaucugcagcgccgugcccucccacugggugccgacgagccgcaccaccugguccauccacgccaagcacgaguggaugaccaccgaggacaugcugacggucuggaaccggguguggauccgcgagaaccccuggauggaggacaagacccccguggagagcugggaggagauccccuaccucggcaagcgggaggaccaguggugcgggucccugaucggccugaccagccgcgccaccugggccaagaacauccaggcggccaucaaccagguccggucccucaucgggaacgaggaguacgccgacuacaugccgagcaugaagcgcuuccggcgcgaggaggaggaggccggcgugcugugguga

SEQ ID NO: 9549 - RNA, 9876 nt, Artificial Sequence
  derived and/or modified CDS sequence (opt1) from DENV-2__FJ410241__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugcccgacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugaagacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcuccggaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagcuggagagcaacauccucgacaucgaccugcgcccggccuccgccuggacccuguacgcgguggccaccaccuucgugacgcccaugcuccggcacagcaucgagaacagcuccgucaacgugagccugaccgccaucgccaaccaggccaccgugcugaugggccucgggaagggcuggccccuguccaagauggacaucggggucccccugcucgcgaucggcugcuacagccaggugaacccgaucacccugacggccgcccugcuccugcugguggcccacuacgcgaucaucgggcccggccuccaggccaaggccacccgcgaggcccagaagcgggccgcggccggcaucaugaagaaccccaccgucgacgggaucaccgugaucgaccuggaccccaucccguacgaccccaaguucgagaagcagcugggccaggugaugcuccugauccugugcgucacccaggugcucaugaugcgcaccaccugggcccugugcgaggcccugacccucgccacggggcccaucuccacccugugggagggcaaccccgggcgguucuggaacaccaccaucgcggugagcauggccaacaucuuccgcggcuccuaccuggccggcgccgggcuccuguucagcaucaugaagaacacgaccaacacccggcgcggcaccgggaacaugggcgagacgcugggcgagaaguggaagucccgccucaacgcccuggggaaguccgaguuccagaucuacaagaaguccggcauccaggaggucgaccggacccuggcgaaggaggggaucaagcgcggcgagaccgaccaccacgccgugagccggggguccgccaagcuccgcugguucguggagcggaacauggucaccccggagggcaaggugguggaccugggcugcgggcgcggcggguggagcuacuacugcggcgggcugaagaacguccgggaggugaagggccucacgaagggcgggcccggccacgaggagcccauccccauguccaccuacggguggaaccuggugcgccugcagagcggcgucgacguguucuucaucccgcccgagaagugcgacacccuccugugcgacaucggggaguccagccccaaccccaccguggaggccggccggacgcugcgcguccucaaccugguggagaacuggcugaacaacaacacccaguucugcaucaaggugcugaacccguacaugcccuccgucaucgagaagauggaggcgcuccagcggaaguacggcggggcccuggugcgcaacccccugagccggaacagcacccacgagauguacuggguguccaacgccagcggcaacaucgucuccagcgugaacaugaucucccgcaugcucaucaaccgguucaccaugcgccacaagaaggccaccuacgagccggacguggaccuggggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggucaacggcguggugcggcuccugaccaagcccugggacguccugccgaccgugacccagauggccaugacggacaccacccccuucgggcagcagcgcguguucaaggagaaggucgacacccgcacgcaggagcccaaggagggcaccaagaagcucaugaagaucaccgccgaguggcuguggaaggagcugggcaagaagaagacgccccggaugugcacgcgcgaggaguucacccggaaggugcgcuccaacgccgcccucggggcgaucuucaccgacgagaacaaguggaaguccgcccgggaggccguggaggacucccgcuucugggagcuggucgacaaggagcggaaccugcaccucgagggcaagugcgagaccugcguguacaacaugauggggaagcgcgagaagaagcugggcgaguucgggaaggccaagggcagccgggccaucugguacauguggcugggcgcgcgcuuccucgaguucgaggcccugggguuccugaacgaggaccacugguucucccgggagaacagccucuccggcgucgagggggagggccugcacaagcugggguacauccuccgcgacgugagcaagaaggagggcggcgccauguacgccgacgacacggcggggugggacacccggaucacccuggaggaccugaagaacgaggagauggugaccaaccacauggagggcgagcacaagaagcucgccgaggccaucuucaagcugacguaccagaacaaggucgugcgcgugcagcggccgacgccccgggggaccgucauggacaucaucagccggcgcgaccagcggggcuccggccagguggggaccuacggccugaacacguucaccaacauggaggcccagcucauccgccagauggagggggagggcguguucaagaacauccagcaccugaccgucaccgaggagguggccgugcagaacuggcuggcgcgggucgggcgcgagcgccucagccggauggccaucuccggcgacgacugcguggugaagccccuggacgaccgcuucgccaacgcccugacggcccucaacgacaugggcaagauccggaaggacauccagcagugggagcccagcaagggguggaacgacuggacccaggucccguucugcucccaccacuuccacgagcugaucaugaaggacggccgcgugcuggugguccccugccggaaccaggacgagcucaucgggcgcgcgcggaucagccagggcgccggguggucccugcgcgagaccgccugccugggcaagagcuacgcccagauguggucccucauguacuuccaccggcgcgaccugcggcuggccgcgaacgccaucugcagcgccgugcccucccacugggugcccaccagccgcacgaccugguccauccacgccaagcacgaguggaugaccaccgaggacaugcucaccgucuggaaccggguguggauccgcgagaacccguggauggaggacaagacgcccguggagagcugggaggagauccccuaccugggcaagcgggaggaccaguggugcgggucccugaucggccucaccagccgcgccaccugggcgaagaacauccaggccgccaucaaccagguccggucccugaucgggaacgaggaguacaccgacuacaugcccagcaugaagcgcuuccggcgcgaggaggaggaggccggcgugcugugguga

SEQ ID NO: 9550 - RNA, 9876 nt, Artificial Sequence
  derived and/or modified CDS sequence (opt1) from DENV-2__FJ410259__SS-prME
agcgccgggaugaucaucaugcugauccccaccgugauggccuuccaccucaccacccgcaacggggagccccacaugaucguggggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaccaccgaggccgagcugaccggguacggcacggucaccauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucacguucaagaacccccacgccaagaagcaggacguggucgugcucggcagccaggagggggcgaugcacaccgcccugaccggcgccaccgagauccagaugagcuccgggaaccuccuguucacgggccaccugaagugccggcugcgcauggacaagcuccagcugaagggcaugagcuacuccaugugcaccgggaaguucaagguggucaaggagaucgccgagacccagcacggcaccaucgugauccgggugcaguacgagggggacggcagccccugcaagauccccuucgagaucauggaccuggagaagcgcuacguccucggccggcugaucacggugaacccgaucgugaccgagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacacggccugggacuucgggucccugggcgggguguucaccagcaucggcaaggcccuccaccaggucuucggggccaucuacggcgcggccuucuccggcgugagcuggaccaugaagauccugaucggggugaucaucaccuggaucggcaugaacucccggagcacgucccugagcgucucccuggugcucguggggaucgucacccuguaccugggcgugauggugcaggccgacagcgggugcgucguguccuggaagaacaaggagcucaagugcggcagcggcaucuucaucaccgacaacgugcacaccuggacggagcaguacaaguuccagcccgagagccccuccaagcuggccagcgcgauccagaaggcccaggaggaggggaucugcggcauccgcuccgucacccggcuggagaaccucauguggaagcagaucacccccgagcugaaccacauccuggccgagaacgaggugaagcucaccaucaugacgggggacauccgcggcaucaugcaggccgggaagcggagccugcgcccgcagcccaccgagcugaaguacuccuggaagaccuggggcaaggccaagaugcucagcaccgaguccuacaaccagacguuccugaucgacggccccgagaccgcggagugcccgaacaccaaccgggccuggaacagccuggagguggaggacuacggguucggcgucuucaccacgaacaucuggcucaagcugaaggagaagcaggacgccuucugcgacuccaagcugaugagcgccgccaucaaggacaaccgcgcggugcacgccgacaugggguacuggaucgaguccgcccucaacgacaccuggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccacggugaucgucaccgaggacugcgggaaccgcggccccucccuccggaccaccacggccagcggcaagcugaucaccgaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacgcggguggggaccaagcacgcgauccuccuggccgccgucuccuucgugacccugaucaccggcaacaugagcuucaaggaccucgggcgcguggucgugauggugggcgccacgauggccgacgacaucgggaugggcgucaccuaccuggcgcugcucgccgccuucaaggugcggcccaccuucgccgccggccugcugcuccgcaagcugaccuccaaggagcugaugaugacgaccaucgggaucgugcuccugagccaguccaccauccccgagaccguccuggagcucacggacgcgcuggcccugggcaugauggugcucaagaucgugcgcaacauggagaaguaccagcuggccgucaccaucauggccauccugugcgugccgaacgccgucauccuccagaacgcguggaaggugagcugcaccauccuggccguggucuccgugagcccccugcuccugaccuccagccagcagaagacggacuggaucccccuggcccucaccaucaaggggcugaaccccaccgccaucuuccugaccacgcucucccggaccaacaagaagcgcagcuggccgcugaacgaggcgaucauggccgugggcauggucuccauccuggccagcucccuccugaagaacgacauccccaugaccggcccccugguggccgggggccuccugaccgugugcuacguccugacggggcggagcgccgaccucgagcuggagcgcgcgaccgacgugaagugggaggaccaggccgagaucuccggcagcagccccauccuguccaucaccaucagcgaggacggguccaugagcaucaagaacgaggaggaggagcagacccucacgauccugauccggaccggccugcucgugaucuccggccuguucccgaucagcauccccaucaccgccgccgccugguaccugugggaggucaagaagcagcgcgcgggggugcucugggacgugcccagcccgccgcccaugggcaaggccgagcuggaggacggggccuaccggaucaagcagaagggcauccugggguacagccagaucggcgccggcgucuacaaggaggggaccuuccacaccauguggcacgugacgcgcggcgccgugcucaugcacaaggggaagcggaucgagcccuccugggcggacgucaagaaggaccugaucagcuacggcgggggcuggaagcuggagggcgaguggaaggagggggaggagguccaggugcucgcccuggagcccggcaagaacccccgcgccguccagaccaagcccgggcuguucaagaccaacaccggcacgaucggggccgugucccucgacuucagccccggcaccuccggcagccccaucaucgacaagaaggggaagguggucggccuguacgggaacggcguggugacccgguccggcgccuacgucagcgcgaucgcccagaccgagaaguccaucgaggacaaccccgagaucgaggacgacaucuuccgcaagcggcgccugacgaucauggaccugcaccccggggccggcaagaccaagcgguaccuccccgccaucgugcgcgaggcgaucaagcgggggcugcgcacccugauccucgccccgacccggguggucgccgccgagauggaggaggcccugcgcggccugcccauccgguaccagacgcccgcgauccgcgccgagcacaccgggcgcgagaucguggaccucaugugccacgccaccuucaccaugcggcugcugagccccgugcgcgucccgaacuacaaccucaucaucauggacgaggcccacuucacggaccccgccuccaucgcggcccggggcuacaucagcacccgcguggagaugggcgaggccgccgggaucuucaugaccgccacgccgcccggcagccgggacccguucccccaguccaacgcgcccaucaucgacgaggagcgcgagauccccgagcggagcuggaacuccgggcacgagugggugacggacuucaagggcaagaccgucugguucgugccgagcaucaaggccgggaacgacaucgccgccugccugcgcaagaacggcaagaaggugauccagcugucccggaagaccuucgacagcgaguacgucaagacccgcacgaacgacugggacuucguggugaccaccgacaucuccgagaugggcgcgaacuucaaggccgagcgggucaucgacccccgccggugcaugaagcccgugauccucaccgacggggaggagcgcgugauccuggccggccccaugccggucacgcacagcuccgccgcccagcggcgcgggcggaucggccgcaaccccaagaacgagaacgaccaguacaucuacaugggggagccccuggagaacgacgaggacugcgcgcacuggaaggaggccaagaugcuccuggacaacaucaacacccccgagggcaucaucccgagcauguucgagcccgagcgggagaagguggacgccaucgacggcgaguaccgccugcgcggggaggcccggaagaccuucguggaccucaugcgccggggcgaccugcccgucuggcuggccuacaagguggcggccgaggggaucaacuacgccgaccgccgguggugcuucgacggcaucaagaacaaccagauccucgaggagaacguggaggucgagaucuggaccaaggagggggagcgcaagaagcugaagccgcgguggcuggacgcccgcaucuacuccgacccccucgcccugaaggaguucaaggaguucgcggccggccggaagucccugacgcucaaccugaucaccgagaugggccgccugcccaccuucaugacccagaagacgcgggacgcccucgacaaccuggccgugcugcacaccgcggaggccgggggccgcgccuacaaccacgcccucuccgagcugcccgagacccuggagacccuccugcugcucacgcugcuggccaccgucaccgggggcaucuuccucuuccugaugagcggccgggggaucggcaagaugacccuggggaugugcugcaucaucaccgcguccauccuccugugguacgcccagauccagccgcacuggaucgccgccagcaucauccuggaguucuuccucaucgugcugcugauccccgagcccgagaagcagcgcacgccccaggacaaccagcucaccuacguggucaucgccauccugaccgugguggcggccaccauggccaacgagaugggcuuccuggagaagacgaagaaggaccucgggcugggcuccaucgccacccagcagccggagagcaacauccuggacaucgaccuccggcccgccuccgcguggacccuguacgccgucgccaccacguucgugacccccaugcugcgccacagcaucgagaacagcuccgugaacgucagccucaccgccaucgccaaccaggcgaccgugcugaugggccuggggaagggcuggccccucuccaagauggacaucggggugccgcugcuggccaucggcugcuacagccaggucaaccccaucacgcucaccgccgcccugcugcuccugguggcgcacuacgccaucaucgggcccggccugcaggccaaggccacccgggaggcccagaagcgcgcggccgccggcaucaugaagaaccccaccguggacgggaucacggucaucgaccucgacccgauccccuacgaccccaaguucgagaagcagcugggccaggugaugcugcucauccugugcgugacccagguccugaugaugcggaccaccugggcccucugcgaggcccugacgcuggcgaccgggcccaucuccacccucugggagggcaacccggggcgcuucuggaacaccacgaucgccgugagcauggccaacaucuuccggggcuccuaccuggccggcgccgggcuccucuucagcaucaugaagaacaccaccaacacccgccgcggcacggggaacaucggcgagacccugggcgagaaguggaagucccggcugaacgcgcucggcaagagcgaguuccagaucuacaagaaguccggcauccaggagguggaccgcacccuggccaaggaggggaucaagcggggcgagaccgaccaccacgccgucagccgcggguccgccaagcugcggugguucguggagcgcaacauggugacgcccgagggcaaggucguggaccucggcugcgggcggggcggguggagcuacuacugcggcgggcugaagaacgugcgcgaggucaagggccugaccaagggcgggcccggccacgaggagcccaucccgauguccaccuacggguggaaccucgugcggcugcagagcggcguggacgucuucuucaucccgcccgagaagugcgacacccugcucugcgacaucggggaguccagccccaacccgacgguggaggcgggccgcacccugcgggugcugaaccucgucgagaacuggcugaacaacaacacccaguucugcaucaaggugcugaaccccuacaugcccuccgugaucgagaagauggaggcccugcagcgcaaguacggcggggcccucguccggaacccgcugagccgcaacagcacccacgagauguacuggguguccaacgccagcggcaacaucguguccagcgucaacaugaucucccggaugcugaucaaccgcuucaccaugcggcacaagaaggccacguacgagcccgacguggaccucgggagcggcacccgcaacaucgggaucgaguccgagauccccaaccuggacaucaucggcaagcggaucgagaagaucaagcaggagcacgagaccagcuggcacuacgaccaggaccaccccuacaagaccugggcguaccacggcuccuacgagacgaagcagaccgggagcgccuccagcauggugaacggcgucgugcgccugcucaccaagccgugggacgugcugcccaccgucacgcagauggccaugaccgacaccacccccuucgggcagcagcgcguguucaaggagaagguggacacgcggacccaggagcccaaggagggcaccaagaagcugaugaagaucaccgccgaguggcucuggaaggagcugggcaagaagaagacgccgcgcaugugcacccgggaggaguucacccgcaagguccgguccaacgccgcgcugggggccaucuucaccgacgagaacaaguggaaguccgcccgcgaggccguggaggacucccgguucugggagcucguggacaaggagcgcaaccugcaccuggagggcaagugcgagacgugcgucuacaacaugauggggaagcgggagaagaagcucggcgaguucgggaaggccaagggcagccgcgcgaucugguacauguggcugggcgcccgguuccuggaguucgaggcccucggguuccugaacgaggaccacugguucucccgcgagaacagccuguccggcguggagggggagggccuccacaagcugggguacauccugcgggacgucagcaagaaggagggcggcgccauguacgcggacgacaccgccgggugggacacccgcaucacccucgaggaccugaagaacgaggagauggugacgaaccacauggagggcgagcacaagaagcuggccgaggccaucuucaagcucaccuaccagaacaaggugguccgggugcagcgccccacgccccgggggaccgugauggacaucaucagccgccgggaccagcgcggcuccgggcaggucggcacguacggccugaacaccuucaccaacauggaggcccagcugauccggcagauggagggggagggcguguucaagaacauccagcaccucaccgugacggaggaggucgcggugcacaacuggcuggcccgcguggggcgcgagcggcugagccgcauggccaucuccggcgacgacugcgucgugaagccccucgacgaccgguucgccaacgcccugaccgcgcugaacgacaugggcaagauccgcaaggacauccagcagugggagccgagcaagggguggaacgacuggacccaggugcccuucugcucccaccacuuccacgagcucaucaugaaggacggccggauccuggucgugcccugccgcaaccaggacgagcugaucgggcgggcccgcaucagccagggcgccggguggucccuccgggagaccgccugccugggcaagagcuacgcccagauguggucccugauguacuuccaccgccgggaccuccgccuggcggccaacgccaucugcagcgccgugcccucccacugggucccgacgagccggaccaccugguccauccacgccaagcacgaguggaugaccaccgaggacaugcugacgguguggaaccgcguguggauccgggagaaccccuggauggaggacaagacccccgucgagagcugggaggagauccccuaccucggcaagcgcgaggaccaguggugcgggucccugaucggccugaccagccgggcgaccugggccaagaacauccaggccgccaucaaccaggugcgcucccucaucgggaacgaggaguacacggacuacaugccgagcaugaagcgguuccgccgcgaggaggaggaggcgggcgugcugugguga

SEQ ID NO: 9551 - RNA, 9876 nt, Artificial Sequence
  derived and/or modified CDS sequence (opt1) from DENV-2__FJ547067__SS-prME
agcgccgggaugaucaucaugcugauccccaccgugauggccuuccaccucaccacccggaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccaucuccuucgugacccugaucaccggcaacaugagcuucaaggaccucgggcggguggucgugauggugggcgccaccauggccgacgacaucgggaugggcgucacguaccuggcccugcucgcggccuucaaggugcgccccaccuucgccgccggccugcugcuccggaagcugaccuccaaggagcugaugaugaccacgaucgggaucgugcuccugagccaguccaccauccccgagaccguccuggagcucaccgacgcccuggcgcugggcaugauggugcucaagaucgugcgcaacauggagaaguaccagcuggccgucacgaucauggccauccugugcgugccgaacgccgucauccuccagaacgccuggaaggugagcugcaccauccuggcggccguguccgucagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggcgaucauggccgugggcaugguguccauccuggccagcucccuccugaagaacgacauccccaugaccggcccccuggucgccgggggccuccugaccgugugcuacgugcugaccgggcgcagcgccgaccucgagcuggagcgggcgacggacgucaagugggaggagcaggccgagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggugaagaagcagcgggcggggguccucugggacgugcccagcccgccgcccaugggcaaggccgagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggcggacgugaagaaggaccugaucagcuacggcgggggcuggaagcuggagggcgaguggaaggagggggaggagguccaggugcucgcccuggagcccggcaagaacccccgggccgugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgcgaucgcccagaccgagaaguccaucgaggacaaccccgagaucgaggacgacaucuuccggaagcgccggcugaccaucauggaccugcaccccggggccggcaagacgaagcgcuaccuccccgccaucguccgggaggcgaucaagcgcgggcugcggacccugauccucgccccgacccgcgugguggccgccgagauggaggaggcccugcggggccugcccauccgcuaccagacccccgcgauccgggccgagcacacggggcgcgagaucgucgaccucaugugccacgccaccuucaccaugcgccugcugagccccgugcgggugccgaacuacaaccucaucaucauggacgaggcccacuucaccgaccccgccuccaucgcggcccgcggcuacaucagcacgcgggucgagaugggcgaggccgccgggaucuucaugaccgccacgccgcccggcagccgcgacccguucccccaguccaacgcgcccaucaucgacgaggagcgggagauccccgagcgcagcuggaacuccgggcacgagugggugaccgacuucaagggcaagacggugugguucgucccgagcaucaaggccgggaacgacaucgccgccugccugcggaagaacggcaagaaggugauccagcugucccgcaagaccuucgacagcgaguacgugaagacccggaccaacgacugggacuucgucgugacgaccgacaucuccgagaugggcgcgaacuucaaggccgagcgcgugaucgacccccggcgcugcaugaagcccgucauccucaccgacggggaggagcgggugauccuggccggccccaugccggugacccacagcuccgccgcccagcgccgggggcgcaucggccggaaccccaagaacgagaacgaccaguacaucuacaugggggagccccuggagaacgacgaggacugcgcgcacuggaaggaggccaagaugcuccuggacaacaucaacacgcccgagggcaucaucccgagcauguucgagcccgagcgcgagaaggucgacgccaucgacggcgaguaccggcugcgcggggaggcccgcaagaccuucguggaccucaugcggcgcggcgaccugcccguguggcuggccuacaaggucgcggccgaggggaucaacuacgccgaccggcgcuggugcuucgacggcaucaagaacaaccagauccucgaggagaacguggagguggagaucuggaccaaggagggggagcggaagaagcugaagccgcgcuggcuggacgcccggaucuacuccgacccccucgcccugaaggaguucaaggaguucgcggccggccgcaagagccugacccucaaccugaucacggagaugggccggcugcccaccuucaugacccagaagacccgcgacgcccucgacaaccuggccguccugcacacggcggaggccgggggccgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgcguccauccuccugugguacgcccagauccagccgcacuggaucgccgccagcaucauccuggaguucuuccucaucguccugcugauccccgagcccgagaagcagcggacgccccaggacaaccagcucacguacguggugaucgccauccugaccgucguggcggccaccauggccaacgagaugggcuuccuggagaagaccaagaaggaccucgggcugggcuccaucgccacgcagcagccggagagcaacauccuggacaucgaccuccgccccgccuccgcguggacccuguacgccguggccaccaccuucgucacgcccaugcugcggcacagcaucgagaacagcuccgugaacgugagccucaccgccaucgccaaccaggcgaccguccugaugggccuggggaagggcuggccccucuccaagauggacaucggggugccgcugcuggccaucggcugcuacagccaggugaaccccaucacccucacggccgcccugcugcuccuggucgcgcacuacgccaucaucgggcccggccugcaggccaaggccacccgcgaggcccagaagcgggcggccgccggcaucaugaagaaccccaccguggacgggaucaccgugaucgaccucgacccgauccccuacgaccccaaguucgagaagcagcugggccaggucaugcugcucauccugugcgugacccaggugcugaugaugcgcaccaccugggcccucugcgaggcccugacccuggcgacggggcccaucuccacccucugggagggcaacccggggcgguucuggaacaccaccaucgccgucagcauggccaacaucuuccgcggcuccuaccuggccggcgccgggcuccucuucagcaucaugaagaacacgaccaacacccggcgcggcaccgggaacaugggcgagacgcugggcgagaaguggaagucccgccugaacgcgcucgggaaguccgaguuccagguguacaagaaguccggcauccaggagguggaccggacccuggccaaggaggggaucaagcgcggcgagaccgaccaccacgccgucagccggggguccgccaagcugcgcugguucguggagcggaacauggugacccccgagggcaaggucguggaccucggcugcgggcgcggcggguggagcuacuacugcggcgggcugaagaacgugcgggaggucaagggccugacgaagggcgggcccggccacgaggagcccaucccgauguccaccuacggguggaaccucgugcgccugcagagcggcguggacgucuucuucaucccgcccgagaagugcgacacccugcucugcgacaucggggaguccagccccaacccgaccguggaggcgggccggacgcugcgcgugcugaaccucgucgagaacuggcugaacaacaacacccaguucugcaucaaggugcugaaccccuacaugcccuccgugaucgagaagauggaggcccugcagcggaaguacggcggggcccucguccgcaacccgcugagccggaacagcacccacgagauguacuggguguccaacgccagcggcaacaucguguccagcgucaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggcguaccacggcuccuacgagaccaagcagacggggagcgccuccagcauggugaacggcgucgugcggcugcucaccaagccgugggacgugcugcccaccgucacccagauggccaugacggacaccacccccuucgggcagcagcgcguguucaaggagaagguggacacccgcacgcaggagcccaaggagggcaccaagaagcugaugaagaucaccgccgaguggcucuggaaggagcugggccggaagaagaccccgcgcaugugcacgcgggaggaguucacccgcaagguccgguccaacgccgcgcugggggccaucuucaccgacgagaacaaguggaaguccgcccgcgaggccguggaggacucccgguucugggagcucguggacaaggagcgcaaccugcaccuggagggcaagugcgagaccugcgucuacaacaugauggggaagcgggagaagaagcucggcgaguucgggaaggccaagggcagccgcgcgaucugguacauguggcugggcgcccgguuccuggaguucgaggcccucggguuccugaacgaggaccacugguucucccgcgagaacagccuguccggcguggagggggagggccuccacaagcugggguacauccugcgggacgucagcaagaaggagggcggcgccauguacgcggacgacacggccgggugggacacccgcaucacccucgaggaccugaagaacgaggagauggugaccaaccacauggagggcgagcacaagaagcuggccgaggccaucuucaagcucacguaccagaacaaggugguccgggugcagcgccccacgccccgggggaccgugauggacaucaucagccgccgggaccagcgcggcuccgggcaggucggcaccuacggccugaacacguucaccaacauggaggcccagcugauccggcagauggagggggagggcguguucaagagcauccagcaccucaccgugaccgaggaggucgcggugcagaacuggcuggcccgcguggggcgcgagcggcugucccgcauggccaucagcggcgacgacugcgucgugaagccccucgacgaccgguucgccaacgcccugacggcgcugaacgacaugggcaagauccgcaaggacauccagcagugggagccguccaagggguggaacgacuggacccaggugcccuucugcagccaccacuuccacgagcucaucaugaaggacggccggguccugguggugcccugccgcaaccaggacgagcugaucgggcgggcccgcaucucccagggcgccggguggagccuccgggagaccgccugccugggcaaguccuacgcccagauguggagccugauguacuuccaccgccgggaccuccgccuggcggccaacgccaucugcuccgccguccccagccacugggugccgaccucccggacgaccuggagcauccacgccaagcacgaguggaugaccaccgaggacaugcugaccguguggaaccgcgucuggauccgggagaaccccuggauggaggacaagacgcccguggaguccugggaggagauccccuaccucggcaagcgcgaggaccaguggugcgggagccugaucggccugaccucccgggcgaccugggccaagaacauccaggccgccaucaaccaggugcgcagccucaucgggaacgaggaguacaccgacuacaugccgagcaugaagcgguuccgccgcgaggaggaggaggcgggcguccugugguga

SEQ ID NO: 9552 - RNA, 9876 nt, Artificial Sequence
  derived and/or modified CDS sequence (opt1) from DENV-2__JN819418__SS-prME
accgccggggugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucaccgagaaggacagccccgugaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugacccuguaccucggggccaugguccaggcggacuccggcugcguggugagcuggaagaacaaggagcugaagugcggcuccgggaucuucaucaccgacaacguccacacguggaccgagcaguacaaguuccagcccgagagccccagcaagcuggccuccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggcgaagaugcugagcacggagucccacaaccagaccuuccugaucgacgggcccgagaccgccgagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggcgguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgcggggcccuggcaccugggcaagcuggagauggacuucgacuucugcgaggggacgaccgugguggucaccgaggacugcggcaaccggggccccagccuccgcaccacgaccgccuccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgcgauccuccugguggccgucuccuucaugacccugaucacggggaacaugagcuuccgggaccucggccgcgugauggugauggucggggccaccaugaccgacgacaucggcaugggcgugaccuaccuggcccugcucgccgcguucaaggugcgccccacguucgccgccgggcugcugcuccggaagcugaccuccaaggagcugaugauggccaccaucggcaucgcccuccugagccaguccaccauccccgagacgauccuggagcucaccgacgcgcuggcccuggggaugaugguccucaagaucgugcgcaacauggagaaguaccagcuggccgugaccaucauggccaucagcugcgucccgaacgccgugauccugcagaacgcguggaagguguccugcaccauccucgccgccgucagcgugagcccccugcugcucacgagcucccagcagaaggccgacuggaucccccuggcgcugaccaucaagggccucaaccccaccgccaucuuccugaccacgcugagccggaccuccaagaagcgcagcuggccgcucaacgaggccaucauggccgucggcaugguguccauccuggccagcagccugcucaagaacgacauccccaugaccgggccccugguggcgggcgggcugcucaccgucugcuacgugcugacgggccgguccgccgaccuggagcucgagcgcgccgccgacgugaagugggaggaccaggccgagaucagcggguccagccccauccuguccaucaccaucagcgaggacggcuccaugagcaucaagaacgaggaggaggagcagacccugaccauccucauccggacgggccugcuggucaucuccggccucuucccggugagcauccccaucaccgcggccgccugguaccugugggaggugaagaagcagcgcgccggcguccugugggacgugcccagcccgccgcccguggggaaggccgagcucgaggacggcgcguaccggaucaagcagcgcgggauccugggcuacagccagaucggcgccggggucuacaaggagggcaccuuccacaccauguggcacgugacccgcggggccgugcugaugcaccgcggcaagcggaucgagcccuccugggccgacgucaagaaggaccucaucagcuacgggggcggcuggaagcuggagggggaguggaaggagggcgaggagguccaggugcuggcccucgagcccgggaagaacccccgcgcgguccagacgaagcccggccuguucaagaccaacaccgggaccaucggcgccgugucccuggacuucagccccggcacguccgggagccccaucguggaccggaagggcaaggucguggggcucuacggcaacggcguggucacccgcuccggggccuacgugagcgccaucgcgcagaccgagaaguccaucgaggacaaccccgagaucgaggacgacaucuuccggaagaagcgccugaccaucauggaccugcaccccggcgccgggaagacgaagcgguaccugcccgccaucgugcgcgaggccaucaagcggggccuccgcacccugauccuggccccgacccgcgucguggcggccgagauggaggaggcccuccgggggcugcccauccgcuaccagacccccgccauccgggccgagcacacgggccgcgagaucguggaccugaugugccacgcgaccuucaccaugcggcuccugucccccguccgcgugccgaacuacaaccugaucaucauggacgaggcccacuucaccgaccccgccagcaucgccgcccggggcuacaucuccacgcgcguggagaugggggaggcggccggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggcgggcaacgacaucgccgccugccuccgcaagaacggcaagaaggucauccagcugucccggaagaccuucgacagcgaguacgugaagacccgcgccaacgacugggacuucguggucaccacggacaucuccgagaugggggccaacuucaaggcggagcgggugaucgacccccgccggugcaugaagcccgugauccugaccgacggcgaggagcgcgucauccucgccgggcccaugccggugacccacagcuccgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacccccgagggcaucaucccgagcauguucgagcccgagcgcgagaagguggacgccaucgacggggaguaccggcugcgcggcgaggcccggaagacguucgucgaccugaugcgccgcggggaccuccccguguggcuggccuaccgcguggccgcggagggcaucaacuacgccgaccggcgcuggugcuucgacgggaucaagaacaaccagauccuggaggagaacgucgagguggagaucuggaccaaggagggcgagcggaagaagcucaagccgcgcuggcuggacgcccggaucuacuccgacccccuggcccucaaggaguucaaggaguucgcggccggccgcaagagccugacccugaaccucaucaccgagauggggcggcugcccacguucaugacccagaaggcccgcgacgcccuggacaaccucgccgugcugcacaccgcggaggccggcgggcgggccuacaaccacgcccuguccgagcuccccgagacccuggagacgcugcuccugcugacccuccuggccaccgucaccggcggcaucuuccuguuccucaugagcgggaagggcaucgggaagaugacgcugggcaugugcugcaucaucaccgcguccauccugcucugguacgcccagauccagccgcacuggaucgccgccagcaucauccuggaguucuuccugaucgugcuccugauccccgagcccgagaagcagcgcacgccccaggacaaccagcugaccuacgucgugaucgccauccucaccguggucgcggccacgauggccaacgagaugggguuccuggagaagaccaagaaggaccugggccucggcagcaucaccacccaggaguccgagagcaacauccuggacaucgaccugcggccggccuccgccuggacgcucuacgcgguggccaccaccuucgugacccccaugcugcgccacagcaucgagaacuccagcgucaacgugucccugacggccaucgccaaccaggcgaccgugcucauggggcugggcaagggguggccccugagcaagauggacaucggcgucccccuccuggccaucgggugcuacucccaggugaacccgaucacccugaccgccgcccuccugcugcucguggcccacuacgcgaucaucggccccggccugcaggccaaggccacgcgggaggcccagaagcgcgccgcggccgggaucaugaagaaccccaccgucgacggcaucaccgugaucgaccuggaccccaucccguacgaccccaaguucgagaagcagcucggccaggugaugcugcugauccucugcgucacccaggugcugaugaugcgcacgaccugggcccugugcgaggcccucacccuggccaccggccccaucagcacgcugugggaggggaaccccggccgguucuggaacaccaccaucgcgguguccauggccaacaucuuccgcggcagcuaccucgccggggccggccugcuguucuccaucaugaagaacaccacgaacacccggcgcgggaccggcaacaucggcgagacccucggggagaaguggaagucccggcugaacgcgcugggcaaguccgaguuccagaucuacaagaaguccgggauccaggaggucgaccgcacgcucgccaaggagggcaucaagcgcggggagaccgaccaccacgccgugucccgcggcagcgccaagcugcggugguucguggagcgcaacauggucaccccggagggcaaggugguggaccuggggugcggccgcggcgggugguccuacuacugcggcgggcucaagaacguccgcgaggugaaggggcugaccaagggcgggcccgggcacgaggagcccauccccaugagcacguacggcuggaaccuggugcggcuccagagcggggucgacguguucuucaccccgcccgagaagugcgacacccugcugugcgacaucggcgaguccagccccaaccccaccaucgaggccggccgcacgcuccgggugcugaaccuggucgagaacuggcucaacaacaacacccaguucugcaucaaggugcugaacccguacaugcccuccgugaucgagaagauggagacccugcagcgcaaguacgggggcgcgcugguccggaacccccucagccgcaacuccacccacgagauguacugggugagcaacgccaccgggaacaucguguccagcgucaacaugaucucccggaugcugaucaaccgcuucacgaugaagcacaagaaggccaccuacgagccggacguggaccugggcagcgggacccgcaacaucggcaucgaguccgagauccccaaccucgacaucaucggcaagcggaucgagaagaucaagcaggagcacgagaccagcuggcacuacgaccaggaccaccccuacaagacgugggccuaccacggguccuacgagaccaagcagaccggcagcgccuccagcauggugaacggggucgugcgccugcugaccaagcccugggacguggucccgauggugacgcagauggcgaugaccgacaccacccccuucggccagcagcggguguucaaggagaaggucgacacgcgcacccaggagcccaaggagggcaccaagaagcucaugaagaucaccgccgaguggcuguggaaggagcuggggaagaagaagacgccccggaugugcacccgcgaggaguucacccggaaggugcgcuccaacgccgcccucggcgccaucuucaccgacgagaacaaguggaaguccgcgcgggaggccguggaggacgggcgcuucugggagcuggucgaccgggagcgcaaccugcaccucgagggcaagugcgagacgugcguguacaacaugauggggaagcgggagaagaagcugggcgaguucggcaaggccaaggggucccgcgccaucugguacauguggcugggcgcgcgguuccucgaguucgaggcccugggguuccugaacgaggaccacugguucagccgcgagaacagccucuccggcguggagggggagggccugcacaagcugggcuacauccuccgggacgucagcaagaaggagggcggggccauguacgccgacgacaccgccgggugggacacccgcaucacccuggaggaccugaagaacgaggagauggugacgaaccacauggagggcgagcacaagaagcucgcggaggccaucuucaagcugaccuaccagaacaaggucgugcgggugcagcgcccgacgccccgggggaccgucauggacaucaucucccgccgcgaccagcggggcagcggccagguggggacguacggccugaacaccuucaccaacauggaggcccagcucauccgccagauggagggggagggcaucuucaaguccauccagcaccugaccgugacggaggagaucgccguccagaacuggcuggcccgggugggccgcgagcggcucagccgcauggcgaucuccggggacgacugcguggucaagccccuggacgaccgguucgccagcgcccugaccgcccucaacgacaugggcaaggugcgcaaggacauccagcagugggagcccucccggggguggaacgacuggacccaggugccguucugcagccaccacuuccacgagcugaucaugaaggacggccgcguccugguggugcccugccggaaccaggacgagcucaucgggcgcgcccggaucucccagggcgcgggcuggagccugaaggagaccgccugccuggggaaguccuacgcccagauguggacgcucauguacuuccaccgccgggaccugcgccuggccgccaacgcgaucugcagcgccguccccucccacugggugcccaccagccggaccaccugguccauccacgccaagcacgaguggaugaccacggaggacaugcucgccguguggaaccgcgucuggauccaggagaacccguggauggaggacaagacccccguggagagcugggaggaggugcccuaccugggcaagcgggaggaccaguggugcgggagccugaucggccucaccucccgcgcgaccugggccaagaacauccagacggccaucaaccagguccgcagccugaucgggaacgaggaguacaccgacuacaugcccuccaugaagcgguuccgccgggaggaggaggaggccggcgugcugugguga

SEQ ID NO: 9553 - RNA, 9876 nt, Artificial Sequence
  derived and/or modified CDS sequence (opt1) from DENV-2__EU482640__SS-prME
accgccggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccaccuacuuccagcgggugcugaucuucauccuccugacgaccguggcccccuccaugaccaugcgcugcaucgggaucagcaaccgggacuucgucgagggcguguccggcgggagcuggguggacaucguccuggagcacggcuccugcgugaccacgauggcgaagaacaagcccacccucgacuucgagcugaucaagaccgaggccaagcaccccgccacccugcgcaaguacugcaucgaggccaagcucacgaacaccaccaccgccagccggugcccgacgcagggggagcccucccugaacgaggagcaggacaagcgcuucgugugcaagcacagcauggucgaccggggcuggggcaacgggugcggccuguucgggaagggcgggaucgugaccugcgcgauguucacgugcaagaagaacauggagggcaagaucgugcagcccgagaaccucgaguacaccaucgucaucacgccccacuccggcgaggagaacgccguggggaacgacaccggcaagcacgggaaggagaucaaggugaccccgcagagcuccaucaccgaggccgagcugaccggcuacgggacggucaccauggagugcagcccccgcaccggccuggacuucaacgagauggugcuccugcagauggagaacaaggccuggcuggugcaccggcagugguuccucgaccugccccugcccuggcucccgggcgccgacacccagggguccaacuggauccagaaggagacgcuggucaccuucaagaacccccacgcgaagaagcaggacguggucgugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaagguggucaaggagaucgccgagacccagcacggcacgaucgugauccgcgugcaguacgagggggacggcagccccugcaagauccccuucgagaucauggaccuggagaagcggcacguccugggccgccucaucaccgugaacccgaucgugaccgagaaggacucccccgucaacaucgaggcggagccgcccuucggggacagcuacaucaucaucggcguggagccggggcagcugaagcuguccugguucaagaagggcagcuccaucgggcagauguucgagaccacgaugcgcggcgccaagcggauggccauccucggcgacaccgccugggacuucgggagccugggcgggguguucaccuccaucggcaaggcccugcaccaggucuucggggcgaucuacggcgccgccuucagcggcguguccuggaccaugaagauccucaucgggguggucaucacguggaucggcaugaacagccgcuccaccagccuguccgugagccuggugcuggucgggguggugacccucuaccugggcgucauggugcaggccgacuccgggugcguggucagcuggaagaacaaggagcugaagugcggcagcggcaucuucaucaccgacaacgugcacacguggaccgagcaguacaaguuccagcccgagucccccagcaagcucgcguccgccauccagaaggcccacgaggaggggaucugcggcauccggagcgugacccgccuggagaaccugauguggcggcagaucacccccgagcucaaccacauccuguccgagaacgaggucaagcugacgaucaugaccggggacaucaagggcaucaugcaggccgggaagcgcagccuccggccgcagcccaccgagcugaaguacuccuggaaggccuggggcaaggcgaagaugcugagcaccgagcuccacaaccacacguuccugaucgacggccccgagaccgccgagugcccgaacaccaaccgcgccuggaacucccuggagguggaggacuacggguucggcguguucaccacgaacaucuggcucaagcugaaggagcggcaggacgucuucugcgacagcaagcugauguccgccgccaucaaggacagccgcgcggugcacgccgacaugggguacuggaucgaguccgcccucaacgacaccuggaagaucgagaaggccagcuucaucgaggugaaguccugccacuggcccaagagccacacccugugguccaacggcguccuggagagcgagaugaucauccccaagaacuucgccggccccgugagccagcacaacuaccggccgggguaccacacccagaccgcgggccccuggcaccucgggcgccuggagauggacuucgacuucugcgagggcacgaccguggucgugaccgaggacugcgggaaccggggccccucccugcgcaccacgaccgccagcggcaagcucaucaccgaguggugcugccgguccugcacccugcccccgcugcgcuaccgcggggaggacggcugcugguacgggauggagauccgcccccucaaggagaaggaggagaaccuggugaacagccuggucacggccggccacgggcagaucgacaacuucucccucggcgugcugggcauggcccuguuccucgaggagaugcugcggacccgcaucgggaccaagcacgcgauccugcucguggccgucagcuucgugacccugaucacgggcaacauguccuuccgcgaccuggggcgggugauggucauggugggcgccaccaugaccgacgacaucgggaugggcgugaccuaccucgcccugcuggccgcguucaagguccgccccacguucgccgccggccuccugcugcggaagcucaccagcaaggagcugaugaugaccaccaucgggaucgugcugcucucccagagcacggugcccgagaccauccuggagcugaccgacgcccucgcccugggcaugaugguccugaagaucgugcgcaacauggagaaguaccagcucgcggucaccaucauggccauccugugcgugccgaacgccgugauccugcagaacgccuggaaggucuccugcacgacccucgccguggugagcgucagcccccugcugcucaccagcucccggcagaaggcggacuggaucccccuggcccugaccaucaaggggcucaaccccacggccaucuuccugaccacccugagccgcaccuccaagaagcggagcuggccgcucaacgaggccaucauggcggugggcaugguguccauccuggccagcagccugcucaagaacgacauccccaugacgggcccccuggucgccgggggccugcucaccgugugcuacgugcugaccgggcgcuccgccgaccuggagcucgagcgggccgcggacguccgcugggaggagcaggccgagaucagcggcuccagccccauccuguccaucaccaucagcgaggacggguccaugagcaucaagaacgaggaggaggagcagacgcugaccauccucauccggaccggccugcuggugaucuccggccucuucccggugagcauccccaucaccgccgccgccugguaccugugggaggucaagaagcagcgcgcgggggugcugugggacgugcccagcccgccgcccgucggcaaggccgagcucgaggacggggccuaccggaucaagcagaagggcauccugggguacagccagaucggcgccggcguguacaaggaggggaccuuccacacgauguggcacgugacccgcggcgccguccugaugcacaaggggaagcggaucgagcccuccugggcggacgugaagaaggaccucaucagcuacggcgggggcuggaagcuggagggcgaguggaaggagggggaggaggugcagguccuggcccucgagcccggcaagaacccccgcgccgugcagaccaagcccgggcuguucaagaccaacacgggcaccaucggggccgugucccuggacuucagccccggcaccuccggcagccccaucgucgacaagaaggggaagguggugggccucuacgggaacggcgucgugacccgguccggcacguacgugagcgccaucgcgcagaccgagaaguccaucgaggacaaccccgagaucgaggacgacaucuuccgcaagaagcggcugaccaucauggaccugcaccccggggccggcaagaccaagcgcuaccugcccgccaucguccgggaggccaucaagcgcgggcuccgcacgcugauccuggcgccgacccgggugguggccgccgagauggaggaggcccuccgcggccugcccauccgguaccagacccccgccauccgcgcggagcacaccgggcgggagaucgucgaccugaugugccacgccacguucaccaugcgccuccugucccccauccgggugccgaacuacaaccugaucaucauggacgaggcccacuucaccgaccccgccagcaucgccgcgcgcggcuacaucuccacccggguggagaugggcgaggccgccgggaucuucaugacggccacgccgcccggcagccgcgacccguucccccaguccaacgcccccaucauggacgaggagcgggagauccccgagcgcagcuggaacuccgggcacgagugggucaccgacuucaagggcaagaccgugugguucgugccgagcaucaaggcggggaacgacaucgccgccugccuccggaagaacggcaagaaggucauccagcugucccgcaagacguucgacagcgaguacaucaagacccggaccaacgacugggacuucguggugaccacggacaucuccgagaugggcgccaacuucaaggcggagcgcgucaucgacccccggcgcugcaugaagcccgugauccugaccgacggggaggagcgggugauccucgccggccccaugccggucacccacagcuccgccgcccagcgccgcgggcgggugggccgcaaccccaagaacgagaacgaccaguacaucuacaugggggagccccuggagaacgacgaggacugcgcccacuggaaggaggcgaagaugcugcucgacaacaucaacacccccgagggcaucaucccgagcauguucgagcccgagcgggagaagguggacgccaucgacggcgaguaccgccugcgcggggaggcccgcaagacguucgucgaccugaugcggcgcggcgaccuccccguguggcuggccuaccgggucgccgcggaggggaucaacuacgccgaccgccgguggugcuucgacggcgugaagaacaaccagauccuggaggagaacguggaggucgagaucuggaccaaggagggggagcgcaagaagcucaagccgcgguggcuggacgcccgcaucuacuccgacccccuggcccucaaggaguucaaggaguucgccgcgggccggaagucccugacccugaaccucaucaccgagaugggccgccugcccacguucaugacccagaaggcccggaacgcccuggacaaccucgccgugcugcacaccgcggaggccgggggccgcgccuacaaccacgcccuguccgagcuccccgagacccuggagacgcugcuccugcugacccuccuggccaccgugaccgggggcaucuuccuguuccucaugagcggcaaggggaucggcaagaugacccuggggaugugcugcaucaucacggcguccauccugcucugguacgcccagauccagccgcacuggaucgccgccagcaucauccuggaguucuuccugaucguccuccugauccccgagcccgagaagcagcggacgccccaggacaaccagcugaccuacguggugaucgccauccucaccgucguggcggccacgauggccaacgagaugggcuuccuggagaagaccaagaaggacuucgggcugggcagcaucaccacccagcagccggaguccaacauccucgacaucgaccugcgccccgccagcgccuggacgcuguacgcgguggccaccaccuucaucacccccaugcuccggcacuccaucgagaacagcuccgucaacgugagccugacggccaucgccaaccaggccaccgugcugaugggccucgggaagggcuggccccuguccaagauggacaucggggucccgcugcucgcgaucggcugcuacagccaggugaaccccaucacccugaccgccgcccugcuccugcugguggcccacuacgcgaucaucgggcccggccuccaggccaaggccacgcgcgaggcccagaagcgcgccgcggccggcaucaugaagaaccccaccgucgacgggaucaccgugaucgaccuggacccgauccccuacgaccccaaguucgagaagcagcugggccaggugaugcuccugguccugugcgugacccaggugcucaugaugcggacgaccugggcccugugcgaggcccugacccucgccaccgggcccaucuccacgcugugggagggcaacccggggcgcuucuggaacaccaccaucgcggucagcauggccaacaucuuccggggcuccuaccuggccggcgccgggcuccuguucagcaucaugaagaacaccgccaacacgcgccggggcaccgggaacaccggcgagacccugggcgagaaguggaagaaccgccucaacgcgcuggggaaguccgaguuccagaucuacaagaaguccggcauccaggagguggaccggacgcuggccaaggaggggaucaagcgcggcgagaccgaccaccacgccgugucccgggggagcgccaagcuccgcugguucgucgagcggaaccuggugacccccgagggcaagguggucgaccugggcugcgggcgcggcgggugguccuacuacugcggcgggcucaagaacgugaaggaggugaagggccugaccaagggcgggcccggccacgaggagcccaucccgaugagcacguacggguggaaccugguccggcuccaguccggcguggacguguucuucacgccgcccgagaagugcgacacccugcugugcgacaucggggagagcagccccaacccgaccgucgaggcgggccgcacccuccgggugcugaaccugguggagaacuggcucaacaacaacacgcaguucugcaucaagguccugaaccccuacaugcccuccgugaucgagaagauggaggcccugcagcgcaaguacggcggggcccuggugcggaacccgcucagccgcaacuccacccacgagauguacugggucagcaacgccuccggcaacaucgugagcuccgugaacaugaucagccggaugcugaucaaccgcuucaccaugcgccacaagaaggccaccuacgagcccgacgucgaccugggguccggcacgcggaacaucgggaucgagagcgagacccccaaccucgacaucaucggcaagcgcaucgagaagaucaagcaggagcacgagaccuccuggcacuacgaccaggaccaccccuacaagaccugggcguaccacggcagcuacgagacgaagcagaccggguccgccagcuccauggugaacggcgugguccggcugcugaccaagccgugggacgugauccccauggugacccagauggccaugacggacaccacccccuucgggcagcagcgcgucuucaaggagaagguggacacccggacgcaggagcccaaggagggcaccaagaagcucaugaagaucaccgccgaguggcuguggaaggagcugggcaagaagaagaccccgcgcaugugcacgcgggaggaguucacccgcaagguccggagcaacgccgcgcucggggccaucuucaccgacgagaacaaguggaaguccgcccgcgaggccguggaggacagcggcuucugggagcugguggacaaggagcggaaccugcaccucgaggggaagugcgagaccugcgucuacaacaugaugggcaagcgcgagaagaagcugggggaguucggcaaggccaagggcucccgggcgaucugguacauguggcugggggcccgcuuccucgaguucgaggcccugggcuuccugaacgaggaccacugguucagccgggagaacagccucuccgggguggagggcgaggggcugcacaagcugggcuacauccuccgcgacgugagcaagaaggagggcggggccauguacgcggacgacacggccggcugggacacccggaucacccuggaggaccugaagaacgaggagauggucaccaaccacauggagggggagcacaagaagcucgccgaggccaucuucaagcugacguaccagaacaagguggugcgcguccagcggcccacgccccggggcaccgugauggacaucaucucccggcgcgaccagcgcgggagcggccagguggucaccuacggccugaacacguucaccaacauggaggcccagcucauccggcagauggagggggagggcguguucaaguccauccagcagcugaccgugaccgaggagaucgcggucaagaacuggcuggcccgcguggggcgggagcgccucagccggauggccaucuccggcgacgacugcguggucaagccccuggacgaccgcuucgccagcgcccugacggcgcucaacgacaugggcaaggugcggaaggacauccagcagugggagccgucccgcggguggaacgacuggacccaggugcccuucugcagccaccacuuccacgagcugaucaugaaggacggccggguccugguggugcccugccgcaaccaggacgagcucaucgggcgggcccgcaucucccagggcgccggguggagcaugcgggagaccgccugccugggcaaguccuacgcccagauguggagccugauguacuuccaccgccgggaccuccgccuggcggccaacgccaucugcuccgccguccccagccacugggugccgaccucccggaccacguggagcauccacgccacccacgaguggaugaccaccgaggacaugcugacgguguggaaccgcgucuggauccaggagaaccccuggauggaggacaagacccccguggagagcugggaggagauccccuaccucggcaagcgggaggaccaguggugcgggucccugaucggccugaccagccgcgcgaccugggccaagaacauccagacggccaucaaccaggugcgcucccucaucgggaacgaggaguacaccgacuacaugccgagcaugaagcgguuccgccgggaggaggaggaggccggcguccugugguga

SEQ ID NO: 9554 - RNA, 9876 nt, Artificial Sequence
  derived and/or modified CDS sequence (opt1) from DENV-2__EU482641__SS-prME
agcgcgggcaugaucaucaugcugauccccaccgugauggccuuccaccucaccacccgcaacggggagccccacaugaucgucggcauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccuccaccugggugaccuacggcacgugcaccaucaccggcgagcaccgccgggagaagcgcagcgucgcccuggugccccacguggggaugggccucgagacccggacggagaccuggauguccagcgagggggccuggaagcacgcccagcgcaucgagaccuggauccugcggcacccgggcuucaccaucauggccgcgauccuggccuacacgaucgggaccacccacuuccagcgcguccucaucuucauccugcugaccgccguggcccccuccaugacgaugcggugcaucggcaucagcaaccgcgacuucguggagggcgucuccgggggcagcuggguggacaucgugcucgagcacggguccugcgucaccaccauggcgaagaacaagcccacccuggacuucgagcugaucaagacggaggccaagcagcccgccacccuccggaaguacugcaucgaggccaagcugaccaacaccacgaccgagagccgcugccccacccagggcgagcccucccugaaggaggagcaggacaagcgguucgugugcaagcacagcaugguggaccgcggcugggggaacggcugcggccuguucggcaagggcgggaucgugaccugcgccauguucacgugcaagaagaacauggagggcaagaucgugcagcccgagaaccuggaguacaccaucguggucacgccccacuccggggaggagcacgcggugggcaacgacaccgggaagcacggcauggagaucaaggugacgccgcagagcuccaucaccgaggccgagcugaccggguacggcaccgucaccauggagugcagcccccggacgggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacaccgcccugacgggcgccaccgagauccagaugagcuccgggaaccuccuguucaccggccaccugaagugccggcugcgcauggacaagcuccagcugaagggcaugagcuacuccaugugcaccgggaaguucaagguggucaaggagaucgccgagacgcagcacggcaccaucgugauccgggugcaguacgagggggacggcagccccugcaagauccccuucgagaucauggaccuggagaagcgcuacguccucggccggcugaucaccgugaacccgaucgugaccgagaaggacucccccgucaacaucgaggccgagccgcccuucggggacagcuacaucaucaucggcguggagccggggcagcugaagcucaacugguucaagaagggcuccagcaucgggcagauguucgagacgaccaugcgcggcgcgaagcgcauggccauccugggcgacaccgccugggacuucgggucccugggcgggguguucaccagcaucggcaaggcccuccaccaggucuucggggccaucuacggcgcggccuucuccggcgugagcuggacgaugaagauccugaucggggugaucaucaccuggaucggcaugaacucccggagcaccucccugagcgucucccuggugcucguggggaucgucacccuguaccugggcgugauggugcaggccgacagcgggugcgucguguccuggaagaacaaggagcucaagugcggcagcggcaucuucaucacggacaacgugcacaccuggaccgagcaguacaaguuccagcccgagagccccuccaagcuggccagcgcgauccagaaggcccaggaggaggggaucugcggcauccgcuccgucacccggcuggagaaccucauguggaagcagaucacgcccgagcugaaccacauccuggccgagaacgaggugaagcucaccaucaugaccggggacauccgcggcaucaugcaggccgggaagcggagccugcgcccgcagcccaccgagcugaaguacuccuggaagacguggggcaaggccaagaugcucagcaccgaguccuacaaccagaccuuccugaucgacggccccgagaccgcggagugcccgaacacgaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacaccuggaagaucgagaaggccagcuucaucgaggugaagaacugccacuggcccaagucccacacgcuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucaccgaggacugcgggaaccgcggccccucccuccggacgaccaccgccagcggcaagcugaucaccgaguggugcugccgcagcugcacgcugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggaccaagcacgcgauccuccuggucgccguguccuucgugacgcugaucaccggcaacaugagcuucaaggaccucgggcgcgucguggugauggucggcgccaccauggccgacgacaucgggaugggcgugaccuaccuggcccugcucgcggccuucaaggugcggcccacguucgccgccggccugcugcuccgcaagcugaccuccaaggagcugaugaugaccaccaucgggaucguccuccugagccaguccacgauccccgagaccgugcuggagcucaccgacgcccuggcgcugggcaugauggugcucaagaucguccgcaacauggagaaguaccagcuggccgugaccaucauggccauccugugcgucccgaacgccgugauccuccagaacgccuggaaggugagcugcacgauccuggcggucguguccgugagcccccugcuccugaccuccagccagcagaagaccgacuggaucccccuggcccucaccaucaaggggcugaaccccacggccaucuuccugaccacccucucccggaccaacaagaagcgcagcuggccgcugaacgaggccaucauggcggucggcaugguguccauccuggccagcucccuccugaagaacgacauccccaugacgggcccccugguggccgggggccuccugaccgucugcuacgugcugaccgggcggagcgccgaccucgagcuggagcgcgccaccgacgugaagugggaggaccaggcggagaucuccggcagcagccccauccuguccaucacgaucagcgaggacggguccaugagcaucaagaacgaggaggaggagcagacccucaccauccugauccggaccggccugcucgucaucuccggccuguucccgaucagcauccccaucacggccgccgccugguaccugugggaggugaagaagcagcgcgccggggugcucugggacguccccagcccgccgcccaugggcaaggcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagaccaagcccgggcuguucaagacgaacaccggcaccaucggggccgugucccucgacuucagccccggcaccuccggcagccccaucaucgacaagaaggggaaggucgugggccuguacgggaacggcguggucacgcgguccggcgccuacgugagcgccaucgcgcagaccgagaaguccaucgaggacaaccccgagaucgaggacgacaucuuccgcaagcggcgccugaccaucauggaccugcaccccggggccggcaagaccaagcgguaccuccccgccaucgugcgcgaggccaucaagcgggggcugcgcacgcugauccucgcgccgacccgggucguggccgccgagauggaggaggcccugcgcggccugcccauccgguaccagacccccgccauccgcgcggagcacaccgggcgcgagaucguggaccucaugugccacgccacguucaccaugcggcugcugagccccguccgcgugccgaacuacaaccucaucaucauggacgaggcccacuucaccgaccccgccuccaucgccgcgcggggcuacaucagcacccgcguggagaugggcgaggccgccgggaucuucaugacggccacgccgcccggcagccgggacccguucccccaguccaacgcccccaucaucgacgaggagcgcgagauccccgagcggagcuggaacuccgggcacgagugggucaccgacuucaagggcaagaccgugugguucgugccgagcaucaaggcggggaacgacaucgccgccugccugcgcaagaacggcaagaaggucauccagcugucccggaagacguucgacagcgaguacgugaagacccgcaccaacgacugggacuucguggucaccacggacaucuccgagaugggcgccaacuucaaggcggagcgggugaucgacccccgccggugcaugaagcccgugauccucaccgacggggaggagcgcgucauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacccccgagggcaucaucccgagcauguucgagcccgagcgggagaagguggacgccaucgacggcgaguaccgccugcgcggggaggcccggaagacguucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgcgggccggaagucccugacccucaaccugaucaccgagaugggccgccugcccacguucaugacccagaagacccgggacgcccucgacaaccuggccguccugcacaccgccgaggccggcgggcgcgccuacaaccacgcccucuccgagcugcccgagacgcuggagacccuccugcugcucacccugcuggccaccgugaccggcgggaucuuccucuuccugaugagcgggcgggggaucgggaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucaccuacgucgugaucgccauccugacgguggucgccgcgaccauggccaacgagaugggcuuccuggagaagaccaagaaggaccucgggcugggcuccaucgccacccagcagccggagagcaacauccuggacaucgaccuccggcccgccuccgccuggacgcuguacgcgguggccaccaccuucgugacccccaugcugcgccacagcaucgagaacagcuccgucaacgugagccucacggccaucgccaaccaggccaccgugcugaugggccuggggaagggcuggccccucuccaagauggacaucggggucccgcugcuggcgaucggcugcuacagccaggugaaccccaucacccucaccgccgcccugcugcuccugguggcccacuacgcgaucaucgggcccggccugcaggccaaggccacgcgggaggcccagaagcgcgccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcggacgaccugggcccucugcgaggcccugacccuggccaccgggcccaucuccacgcucugggagggcaacccggggcgcuucuggaacaccaccaucgcggugagcauggccaacaucuuccggggcuccuaccuggccggcgccgggcuccucuucagcaucaugaagaacaccacgaacacccgccgcggcaccgggaacaucggcgagacccugggcgagaaguggaagucccggcugaacgcccucggcaagagcgaguuccagaucuacaagaaguccggcauccaggaggucgaccgcacgcuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggcccggccacgaggagcccaucccgauguccacguacggguggaaccucgugcggcugcagagcggcgucgacguguucuucaucccgcccgagaagugcgacacccugcucugcgacaucggggaguccagccccaacccgaccguggaggccggccgcacccugcggguccugaaccucguggagaacuggcugaacaacaacacgcaguucugcaucaaggugcugaaccccuacaugcccuccgucaucgagaagauggaggcgcugcagcgcaaguacggcggggcccucgugcggaacccgcugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacccgcaacaucgggaucgaguccgagauccccaaccuggacaucaucggcaagcggaucgagaagaucaagcaggagcacgagacgagcuggcacuacgaccaggaccaccccuacaagaccugggccuaccacggcuccuacgagaccaagcagaccgggagcgcguccagcauggucaacggcguggugcgccugcucacgaagccgugggacguccugcccaccgugacccagauggccaugaccgacacgacccccuucgggcagcagcgcguguucaaggagaaggucgacacccggacccaggagcccaaggagggcacgaagaagcugaugaagaucaccgccgaguggcucuggaaggagcugggcaagaagaagaccccgcgcaugugcacccgggaggaguucacgcgcaaggugcgguccaacgccgcccugggggcgaucuucaccgacgagaacaaguggaaguccgcccgcgaggccguggaggacucccgguucugggagcucgucgacaaggagcgcaaccugcaccuggagggcaagugcgagaccugcguguacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcgucgagggggagggccuccacaagcugggguacauccugcgggacgugagcaagaaggagggcggcgccauguacgccgacgacaccgcggggugggacacgcgcaucacccucgaggaccugaagaacgaggagauggugaccaaccacauggagggcgagcacaagaagcuggccgaggccaucuucaagcucaccuaccagaacaaggucgugcgggugcagcgccccacgccccgggggaccgucauggacaucaucagccgccgggaccagcgcggcuccgggcaggucggcaccuacggccugaacaccuucacgaacauggaggcccagcugauccggcagauggagggggagggcguguucaagaacauccagcaccucaccgucaccgaggagguggccgugcacaacuggcuggcgcgcgucgggcgcgagcggcugagccgcauggccaucuccggcgacgacugcguggugaagccccucgacgaccgguucgccaacgcccugaccgcccugaacgacaugggcaagauccgcaaggacauccagcagugggagccgagcaagggguggaacgacuggacgcagguccccuucugcucccaccacuuccacgagcucaucaugaaggacggccggauccugguggugcccugccgcaaccaggacgagcugaucgggcgggcgcgcaucagccagggcgccggguggucccuccgggagaccgccugccugggcaagagcuacgcccagauguggucccugauguacuuccaccgccgggaccuccgccuggccgcgaacgccaucugcagcgccguccccucccacugggugccgaccagccggaccacgugguccauccacgccaagcacgaguggaugaccaccgaggacaugcugaccguguggaaccgcgucuggauccgggagaaccccuggauggaggacaagacccccguggagagcugggaggagauccccuaccucggcaagcgcgaggaccaguggugcgggucccugaucggccugacgagccgggccaccugggcgaagaacauccaggccgccaucaaccaggugcgcucccucaucgggaacgaggaguacaccgacuacaugccgagcaugaagcgguuccgccgcgaggaggaggaggccggcguccugugguga

SEQ ID NO: 9555 - RNA, 9876 nt, Artificial Sequence
  derived and/or modified CDS sequence (opt1) from DENV-2__EU482642__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccguguucgagcugaccgacgcccucgcgcugggcaugauggugcugaagaucguccgcaacauggagaaguaccagcucgccgugacgaucauggccauccugugcgucccgaacgccgugauccugcagaacgccuggaaggugagcugcaccauccucgcggucguguccgugagcccccugcugcucaccuccagccagcagaagaccgacuggaucccccuggcccugacgaucaaggggcucaaccccaccgccaucuuccugaccacccugucccgcacgaacaagaagcggagcuggccgcucaacgaggccaucauggcggucggcaugguguccauccuggccagcucccugcucaagaacgacauccccaugaccggcccccugguggccgggggccugcucaccgucugcuacgugcugaccgggcgcagcgccgaccuggagcucgagcgggccacggacgugaagugggaggaccaggcggagaucuccggcagcagccccauccuguccaucaccaucagcgaggacggguccaugagcaucaagaacgaggaggaggagcagacccugaccauccucauccgcacgggccugcuggucaucuccggccucuucccgaucagcauccccaucaccgccgccgccugguaccugugggaggugaagaagcagcgggccggggugcugugggacguccccagcccgccgcccaugggcaaggcggagcucgaggacggggccuaccgcaucaagcagaagggcauccugggguacagccagaucggcgccggcguguacaaggaggggaccuuccacaccauguggcacgugacccggggcgccguccugaugcacaaggggaagcgcaucgagcccuccugggccgacgugaagaaggaccucaucagcuacggcgggggcuggaagcuggagggcgaguggaaggagggggaggaggugcagguccuggcgcucgagcccggcaagaacccccgggccgugcagacgaagcccgggcuguucaagaccaacaccggcaccaucggggccgugucccuggacuucagccccggcacguccggcagccccaucaucgacaagaaggggaaggucgugggccucuacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccugcccgccaucgugcgggaggccaucaagcgcgggcuccggacccugauccuggcgccgacccgcgucguggccgccgagauggaggaggcccuccggggccugcccauccgcuaccagacccccgccauccgggcggagcacacggggcgcgagaucguggaccugaugugccacgccaccuucaccaugcgccuccugagccccguccgggugccgaacuacaaccugaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccuccggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccugaccgacggggaggagcgggucauccucgccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcugcucgacaacaucaacacgcccgagggcaucaucccgagcauguucgagcccgagcgcgagaagguggacgccaucgacggcgaguaccggcugcgcggggaggcccgcaagaccuucgucgaccugaugcggcgcggcgaccuccccguguggcuggccuacaagguggccgcggaggggaucaacuacgccgaccggcgcuggugcuucgacggcaucaagaacaaccagauccuggaggagaacgucgagguggagaucuggaccaaggagggggagcggaagaagcucaagccgcgcuggcuggacgcccggaucuacuccgacccccuggcccucaaggaguucaaggaguucgccgcgggccgcaagagccugacccugaaccucaucacggagaugggccggcugcccaccuucaugacccagaagacccgcgacgcccuggacaaccucgccguccugcacacggccgaggccggcgggcgggccuacaaccacgcccuguccgagcuccccgagacccuggagacccugcuccugcugacccuccuggccacggugaccgggggcaucuuccuguuccucaugagcggccgcgggaucggcaagaugacccuggggaugugcugcaucaucaccgccuccauccugcucugguacgcgcagauccagccgcacuggaucgccgccagcaucauccuggaguucuuccugaucgugcuccugauccccgagcccgagaagcagcggacgccccaggacaaccagcugacguacgucgugaucgccauccucaccguggucgccgcgaccauggccaacgagaugggcuuccuggagaagaccaagaaggaccuggggcucggcuccaucgccacgcagcagccggagagcaacauccuggacaucgaccugcgccccgccuccgccuggacccucuacgcgguggccaccaccuucgugacgcccaugcugcggcacagcaucgagaacagcuccgucaacgugagccugaccgccaucgccaaccaggccaccgugcucaugggccuggggaagggcuggccccuguccaagauggacaucggggucccgcuccuggcgaucggcugcuacagccaggugaaccccaucacccugacggccgcccuccugcugcucguggcccacuacgcgaucaucgggcccggccugcaggccaaggccacccgcgaggcccagaagcgggccgcggccggcaucaugaagaaccccaccgucgacgggaucaccgugaucgaccuggacccgauccccuacgaccccaaguucgagaagcagcucggccaggugaugcugcugauccucugcgucacccaggugcugaugaugcgcaccaccugggcccugugcgaggcccucacccuggccacggggcccaucuccacccugugggagggcaacccggggcgguucuggaacaccaccaucgcggugagcauggccaacaucuuccgcggcuccuaccucgccggcgccgggcugcuguucagcaucaugaagaacacgaccaacacccggcgcggcaccgggaacaugggcgagacgcucggcgagaaguggaagucccgccugaacgcccuggggaaguccgaguuccagaucuacaagaaguccggcauccaggaggucgaccggacccucgcgaaggaggggaucaagcgcggcgagaccgaccaccacgccgugagccggggguccgccaagcugcgcugguucguggagcggaacauggucacccccgagggcaaggugguggaccugggcugcgggcgcggcggguggagcuacuacugcggcgggcucaagaacguccgggaggugaagggccugacgaagggcgggcccggccacgaggagcccaucccgauguccaccuacggguggaaccuggugcgccuccagagcggcgucgacguguucuucaucccgcccgagaagugcgacacccugcugugcgacaucggggaguccagccccaacccgaccguggaggccggccggacgcuccgcguccugaaccugguggagaacuggcucaacaacaacacccaguucugcaucaaggugcugaaccccuacaugcccuccgucaucgagaagauggaggcgcugcagcggaaguacggcggggcccuggugcgcaacccgcucagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccuggggagcggcacgcggaacaucgggaucgaguccgagauccccaaccucgacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggucaacggcguggugcggcugcugaccaagccgugggacguccuccccaccgugacccagauggccaugacggacaccacccccuucgggcagcagcgcguguucaaggagaaggucgacacccgcacgcaggagcccaaggagggcaccaagaagcugaugaagaucaccgccgaguggcuguggaaggagcucggcaagaagaagaccccgcggaucugcacgcgcgaggaguucacccggaaggugcgcuccaacgccgcccugggggcgaucuucaccgacgagaacaaguggaaguccgcccgggaggccguggaggacucccgcuucugggagcuggucgacaaggagcggaaccuccaccuggagggcaagugcgagaccugcguguacaacaugauggggaagcgcgagaagaagcugggcgaguucgggaaggccaagggcagccgggccaucugguacauguggcucggcgcgcgcuuccuggaguucgaggcccugggguuccucaacgaggaccacugguucucccgggagaacagccuguccggcgucgagggggagggccugcacaagcucggguacauccugcgcgacgugagcaagaaggagggcggcgccauguacgccgacgacacggcggggugggacacccggaucacccuggaggaccucaagaacgaggagauggugaccaaccacauggagggcgagcacaagaagcuggccgaggccaucuucaagcugacguaccagaacaaggucgugcgcgugcagcggcccacgccccgggggaccgucauggacaucaucagccggaaggaccagcgcggcuccggccagguggggaccuacggccucaacacguucaccaacauggaggcccagcugauccggcagauggagggggagggcguguucaagaacauccagcaccugaccgucaccgaggagguggccgugcagaacuggcucgcgcgcgucgggcgggagcgccugagccgcauggccaucuccggcgacgacugcguggugaagccccuggacgaccgguucgccaacgcccucacggcccugaacgacaugggcaagauccgcaaggacauccagcagugggagccgagcaagggguggaacgacuggacccagguccccuucugcucccaccacuuccacgagcugaucaugaaggacggccgggugcucgugguccccugccgcaaccaggacgagcugaucgggcgggcgcgcaucagccagggcgccggguggucccugcgggagaccgccugccucggcaagagcuacgcccagauguggucccugauguacuuccaccgccgggaccugcgccucgccgcgaacgccaucugcagcgccgugcccucccacugggugccgaccagccggacgaccugguccauccacgccaagcacgaguggaugaccaccgaggacaugcugaccgucuggaaccgcguguggauccaggagaaccccuggauggaggacaagacgcccguggagagcugggaggagauccccuaccugggcaagcgggaggaccaguggugcgggucccucaucggccugaccagccgcgccaccugggcgaagaacauccaggccgccaucaaccagguccggucccugaucgggaacgaggaguacaccgacuacaugccgagcaugaagcgcuuccggcgcgaggaggaggaggccggcgugcucugguga

SEQ ID NO: 9556 - RNA, 9876 nt, Artificial Sequence
  derived and/or modified CDS sequence (opt1) from DENV-2__EU482643__SS-prME
agcgcgggcaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagaugaagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacgaccgagugcccgaacaccaaccgcgcguggaacagccuggagguggaggacuacggguucggcgucuucaccacgaacaucuggcucaagcugaaggagaagcaggacgccuucugcgacuccaagcugaugagcgccgccaucaaggacaaccgggccgugcacgcggacaugggguacuggaucgaguccgcccucaacgacaccuggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgccggccccuggcaccuggggaagcuggagauggacuucgacuucugcgacggcaccacggugaucgucaccgaggacugcgggaaccggggccccucccuccgcaccaccacggcgagcggcaagcugaucaccgaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacgcgcguggggaccaagcacgccauccuccuggucaccguguccuucgugacccugaucacgggcaacaugagcuucaaggaccucgggcgggucguggugauggucggcgcgaccauggccgacgacaucgggaugggcgugaccuaccuggcccugcucgccgccuucaaggugcgccccaccuucgcggccggccugcugcuccggaagcugacguccaaggagcugaugaugaccaccaucgggaucguccuccugagccaguccaccauccccgagacggugcuggagcucaccgacgcccuggcccugggcaugauggugcucaagaucguccgcaacauggagaaguaccagcuggccgugaccaucauggcgauccugugcgucccgaacgccgugauccuccagaacgccuggaaggugagcugcaccauccuggccgucguguccgugagcccccugcuccugacguccagccagcagaagaccgacuggaucccccuggcccucaccaucaaggggcugaaccccaccgcgaucuuccugacgacccucucccgcaccaacaagaagcggagcuggccgcugaacgaggccaucauggccgucggcaugguguccauccuggccagcucccuccugaagaacgacauccccaugaccggcccccugguggccggcgggcuccugacggucugcuacgugcugaccgggcgcagcgccgaccucgagcuggagcgggccaccgacgugaagugggaggaccaggccgagaucuccgggagcagccccauccuguccaucaccaucagcgaggacggguccaugagcaucaagaacgaggaggaggagcagacgcucaccauccugauccgcaccggccugcucgucaucuccggccuguucccgaucagcauccccaucaccgccgcggccugguaccugugggaggugaagaagcagcgggccggggugcucugggacguccccagcccgccgcccaugggcaaggccgagcuggaggacggggccuaccgcaucaagcagaagggcauccugggguacagccagaucggcgcgggcguguacaaggaggggaccuuccacacgauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggccgugcagaccaagcccgggcuguucaagaccaacacgggcaccaucggggcggugucccucgacuucagccccggcaccuccggcagccccaucaucgacaagaaggggaaggucgugggccuguacgggaacggcguggucacccgcuccggcgccuacgugagcgccaucgcccagacggagaaguccaucgaggacaaccccgagaucgaggacgacaucuuccggaagcgccggcugaccaucauggaccugcaccccggggccggcaagaccaagcgcuaccuccccgcgaucgugcgggaggccaucaagcgcgggcugcggacccugauccucgccccgacgcgcgucguggccgcggagauggaggaggcccugcggggccugcccauccgcuaccagacccccgccauccgggccgagcacaccgggcgcgagaucguggaccucaugugccacgccaccuucacgaugcgccugcugagccccguccgggugccgaacuacaaccucaucaucauggacgaggcgcacuucaccgaccccgccuccaucgccgcccgcggcuacaucagcacccggguggagaugggcgaggccgcggggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagaccgugugguucgugccgagcaucaaggccgggaacgacaucgccgcgugccugcggaagaacggcaagaaggucauccagcugucccgcaagaccuucgacagcgaguacgugaagacgcggaccaacgacugggacuucguggucaccaccgacaucuccgagaugggcgccaacuucaaggccgagcgcgugaucgacccccggcgcugcaugaagcccgugauccucacggacggggaggagcgggucauccuggccggccccaugccggugacccacagcuccgcggcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgccaucgacggcgaguaccggcugcgcggggaggcgcgcaagaccuucgucgaccucaugcggcgcggcgaccugcccguguggcuggccuacaagguggccgccgaggggaucaacuacgccgaccggcgcuggugcuucgacggcaucaagaacaaccagauccucgaggagaacgucgagguggagaucuggacgaaggagggggagcggaagaagcugaagccgcgcuggcuggacgcgcggaucuacuccgacccccucgcccugaaggaguucaaggaguucgccgccggccgcaagagccugacccucaaccugaucaccgagaugggccggcugcccaccuucaugacgcagaagacccgcgacgcccucgacaaccuggcgguccugcacaccgccgaggccgggggccgggccuacaaccacgcgcucuccgagcugcccgagacccuggagacgcuccugcugcucacccugcuggccaccgugaccgggggcaucuuccucuuccugaugagcggccgcgggaucggcaagaugacccuggggaugugcugcaucaucacggccuccauccuccugugguacgcccagauccagccgcacuggaucgccgcgagcaucauccuggaguucuuccucaucgugcugcugauccccgagcccgagaagcagcggacgccccaggacaaccagcucaccuacgucgugaucgccauccugaccguggucgccgccacgauggccaacgagaugggcuuccuggagaagaccaagaaggaccucgggcugggcuccaucgcgacccagcagccggagagcaacauccuggacaucgaccuccgccccgccuccgccuggacccuguacgccguggccacgaccuucgugacccccaugcugcggcacagcaucgagaacagcuccgucaacgugagccucaccgcgaucgccaaccaggccacggugcugaugggccuggggaagggcuggccccucuccaagauggacaucggggucccgcugcuggccaucggcugcuacagccaggugaaccccaucacccucaccgccgcgcugcugcuccugguggcccacuacgccaucaucgggcccggccugcaggccaaggcgacccgcgaggcccagaagcgggccgccgccggcaucaugaagaaccccacggucgacgggaucaccgugaucgaccucgacccgauccccuacgaccccaaguucgagaagcagcugggccaggugaugcugcucauccugugcgucacccaggugcugaugaugcgcaccacgugggcgcucugcgaggcccugacccuggccaccgggcccaucuccacccucugggagggcaacccggggcgguucuggaacacgaccaucgccgugagcauggccaacaucuuccgcggcuccuaccuggcgggcgccgggcuccucuucagcaucaugaagaacaccaccaacacgcggcgcggcaccgggaacaucggcgagacccugggcgagaaguggaagucccgccugaacgcccucgggaaguccgaguuccagaucuacaagaaguccggcauccaggaggucgaccggacccuggccaaggaggggaucaagcgcggcgagacggaccaccacgccgugagccggggguccgcgaagcugcgcugguucguggagcggaacauggucacccccgagggcaaggugguggaccucggcugcgggcgcggcggguggagcuacuacugcggcgggcugaagaacguccgggaggugaagggccugaccaagggcgggcccggccacgaggagcccaucccgauguccaccuacggguggaaccucgugcgccugcagagcggcgucgacguguucuucaucccgcccgagaagugcgacacgcugcucugcgacaucggggaguccagccccaacccgaccguggaggccggccggacccugcgcguccugaaccucguggagaacuggcugaacaacaacacccaguucugcaucaaggugcugaaccccuacaugcccuccgucaucgagaagauggaggcccugcagcggaaguacggcggggcccucgugcgcaacccgcugagccggaacagcacccacgagauguacuggguguccaacgcgagcggcaacaucgucuccagcgugaacaugaucucccgcaugcugaucaaccgguucacgaugcgccacaagaaggccaccuacgagcccgacguggaccucgggagcggcacccggaacaucgggaucgaguccgagauccccaaccuggacaucaucggcaagcgcaucgagaagaucaagcaggagcacgagaccagcuggcacuacgaccaggaccaccccuacaagacgugggccuaccacggcuccuacgagaccaagcagaccgggagcgccuccagcauggucaacggcguggugcggcugcucaccaagccgugggacguccugcccacggugacccagauggccaugaccgacaccacgcccuucgggcagcagcgcguguucaaggagaaggucgacacccgcacccaggagcccaaggagggcaccaagaagcugaugaagaucacggcggaguggcucuggaaggagcugggcaagaagaagaccccgcggaugugcacccgcgaggaguucacccggaaggugcgcuccaacgccgcccugggggccaucuucacggacgagaacaaguggaaguccgcccgggaggcgguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcccgcuuccuggaguucgaggcccucggguuccugaacgaggaccacugguucucccgggagaacagccuguccggcgucgagggggagggccuccacaagcugggguacauccugcgcgacgugagcaagaaggagggcggcgcgauguacgccgacgacaccgccgggugggacacccggaucacgcucgaggaccugaagaacgaggagauggugaccaaccacauggagggcgagcacaagaagcuggccgaggcgaucuucaagcucaccuaccagaacaaggucgugcgcgugcagcggcccacgccccgggggacggucauggacaucaucagccggcgcgaccagcggggcuccggccagguggggaccuacggccugaacaccuucaccaacauggaggcccagcugauccgccagauggagggggagggcguguucaagaacauccagcaccucacggucaccgaggagguggccgugcagaacuggcuggcccgggucgggcgcgagcgccugagccggauggccaucuccggcgacgacugcguggugaagccccucgacgaccgcuucgcgaacgcccugaccgcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcccggaucagccagggcgccggguggucccuccgcgagacggcgugccugggcaagagcuacgcccagauguggucccugauguacuuccaccggcgcgaccuccggcuggccgccaacgccaucugcagcgcggugcccucccacugggugccgaccagccgcaccaccugguccauccacgccaagcacgaguggaugaccacggaggacaugcugaccgucuggaaccggguguggauccgcgacaaccccuggauggaggacaagacccccguggagagcugggaggagauccccuaccucggcaagcgggaggaccaguggugcgggucccugaucggccugaccagccgcgccacgugggccaagaacauccaggccgcgaucaaccagguccggucccucauggggaacgaggaguacaccgacuacaugccgagcaugaagcgcuuccggcgcgaggaggaggaggccggcgugcugugguga

SEQ ID NO: 9557 - RNA, 9876 nt, Artificial Sequence
  derived and/or modified CDS sequence (opt1) from DENV-2__EU482644__SS-prME
agcgccgggaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggacgggcgugaccuaccuggcccugcucgcggccuucaaggugcgccccaccuucgccgccggccugcugcuccggaagcugaccuccaaggagcugaugaugacgaccaucgggaucguccuccugagccaguccaccauccccgagaccgugcuggagcucacggacgcccuggcgcugggcaugauggugcucaagaucguccgcaacauggagaaguaccagcuggccgugaccaucaugaccauccugugcgucccgaacgccgugauccuccagaacgccuggaaggugagcugcaccauccuggccgucguguccgugagcccccugcuccugacguccagccagcagaagaccgacuggaucccccuggcgcucaccaucaaggggcugaaccccaccgccaucuuccugacgacccucucccgcaccaacaagaagcggagcuggccgcugaacgaggccaucauggccgucggcaugguguccauccuggcgagcucccuccugaagaacgacauccccaugaccggcccccugguggccgggggccuccugacggucugcuacgugcugaccgggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacgcucaccauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguacaaggaggggaccuuccacacgauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagaccaagcccgggcuguucaagaccaacacgggcaccaucggggccgugucccucgacuucagccccggcaccuccggcagccccaucaucgacaagaaggggaaggucgugggccuguacgggaacggcguggucacccgcuccggcgccuacgugagcgccaucgcccagacggagaaguccaucgaggacaaccccgagaucgaggacgacaucuuccggaagcgccggcugaccaucauggaccugcaccccggggcgggcaagaccaagcgcuaccuccccgccaucgugcgggaggccaucaagcgcgggcugcggacccugauccucgccccgacgcgcgucguggcggccgagauggaggaggcccugcggggccugcccauccgcuaccagacccccgccauccgggccgagcacaccgggcgcgagaucguggaccucaugugccacgcgaccuucacgaugcgccugcugagccccguccgggugccgaacuacaaccucaucaucauggacgaggcccacuucaccgaccccgccuccaucgccgcccgcggcuacaucagcacccggguggagaugggcgaggcggccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagaccgugugguucgugccgagcaucaaggccgggaacgacaucgcggccugccugcggaagaacggcaagaaggucauccagcugucccgcaagaccuucgacagcgaguacgugaagacgcggaccaacgacugggacuucguggucaccaccgacaucuccgagaugggcgccaacuucaaggccgagcgcgugaucgacccccggcgcugcaugaagcccgugauccucacggacggggaggagcgggucauccuggcgggccccaugccggugacccacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgcgaucgacggcgaguaccggcugcgcggggaggcccgcaagaccuucgucgaccucaugcggcgcggcgaccugcccguguggcuggccuacaagguggccgccgaggggaucaacuacgcggaccggcgcuggugcuucgacggcaucaagaacaaccagauccucgaggagaacgucgagguggagaucuggacgaaggagggggagcggaagaagcugaagccgcgcuggcuggacgcccggaucuacuccgacccccucgcccugaaggaguucaaggaguucgccgccggccgcaagagccugacccucaaccugaucaccgagaugggccggcugcccaccuucaugacgcagaagacccgcgacgcgcucgacaaccuggccguccugcacaccgccgaggccgggggccgggcguacaaccacgcccucuccgagcugcccgagacccuggagacgcuccugcugcucacccugcuggccaccgugaccgggggcaucuuccucuuccugaugagcggccgcgggaucggcaagaugacccuggggaugugcugcaucaucacggccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugaccguggucgccgccacgauggcgaacgagaugggcuuccuggagaagaccaagaaggaccucgggcugggcuccaucgccacccagcagccggagagcaacauccuggacaucgaccuccgccccgccuccgccuggacccuguacgccguggcgacgaccuucgugacccccaugcugcggcacagcaucgagaacagcuccgucaacgugagccucaccgccaucgccaaccaggccacggugcugaugggccuggggaagggcuggccccucuccaagauggacaucggggucccgcugcuggccaucggcugcuacagccaggugaaccccaucacccucaccgcggcccugcugcuccugguggcccacuacgccaucaucgggcccggccugcaggcgaaggccacccgcgaggcccagaagcgggccgccgcgggcaucaugaagaaccccacggucgacgggaucaccgugaucgaccucgacccgauccccuacgaccccaaguucgagaagcagcugggccaggugaugcugcucauccugugcgucacccaggugcugaugaugcgcaccacgugggcccucugcgaggcccugacccuggccaccgggcccaucuccacccucugggagggcaacccggggcgguucuggaacacgaccaucgccgugagcauggcgaacaucuuccgcggcuccuaccuggccggcgccgggcuccucuucagcaucaugaagaacaccaccaacacgcggcgcggcaccgggaacaugggcgagacccugggcgagaaguggaagucccgccugaacgcccucgggaaguccgaguuccagaucuacaagaaguccggcauccaggaggucgaccggacccuggccaaggaggggaucaagcgcggcgagacggaccaccacgcggugagccggggguccgccaagcugcgcugguucguggagcggaacauggucacccccgagggcaaggugguggaccucggcugcgggcgcggcggguggagcuacuacugcggcgggcugaagaacguccgggaggugaagggccugaccaagggcgggcccggccacgaggagcccaucccgauguccaccuacggguggaaccucgugcgccugcagagcggcgucgacguguucuucaucccgcccgagaagugcgacacgcugcucugcgacaucggggaguccagccccaacccgaccguggaggccggccggacccugcgcguccugaaccucguggagaacuggcugaacaacaacacccaguucugcaucaaggugcugaaccccuacaugcccuccgucaucgagaagauggaggcccugcagcggaaguacggcggggcgcucgugcgcaacccgcugagccggaacagcacccacgagauguacuggguguccaacgccagcggcaacaucgucuccagcgugaacaugaucucccgcaugcugaucaaccgguucacgaugcgccacaagaaggccaccuacgagcccgacguggaccucgggagcggcacccggaacaucgggaucgaguccgagauccccaaccuggacaucaucggcaagcgcaucgagaagaucaagcaggagcacgagaccagcuggcacuacgaccaggaccaccccuacaagacgugggccuaccacggcuccuacgagaccaagcagaccgggagcgccuccagcauggucaacggcguggugcggcugcucaccaagccgugggacguccugcccacggugacccagauggcgaugaccgacaccacgcccuucgggcagcagcgcguguucaaggagaaggucgacacccgcacccaggagcccaaggagggcaccaagaagcugaugaagaucacggccgaguggcucuggaaggagcugggcaagaagaagaccccgcggaugugcacccgcgaggaguucacccggaaggugcgcuccaacgccgcccugggggccaucuucacggacgagaacaaguggaaguccgcgcgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcccgcuuccuggaguucgaggcgcucggguuccugaacgaggaccacugguucucccgggagaacagccuguccggcgucgagggggagggccuccacaagcugggguacauccugcgcgacgugagcaagaaggagggcggcgccauguacgccgacgacaccgccgggugggacacccggaucacgcucgaggaccugaagaacgaggagauggugaccaaccacauggagggcgagcacaagaagcuggcggaggccaucuucaagcucaccuaccagaacaaggucgugcgcgugcagcggcccacgccccgggggacggucauggacaucaucagccggcgcgaccagcggggcuccggccagguggggaccuacggccugaacaccuucaccaacauggaggcccagcugauccgccagauggagggggagggcguguucaagaacauccagcaccucacggucaccgaggagguggccgugcagaacuggcuggcccgggucgggcgcgagcgccugagccggauggcgaucuccggcgacgacugcguggugaagccccucgacgaccgcuucgccaacgcccugaccgcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcccggaucagccagggcgcgggguggucccuccgcgagacggccugccugggcaagagcuacgcccagauguggucccugauguacuuccaccggcgcgaccuccggcuggccgccaacgcgaucugcagcgccgugcccucccacugggugccgaccagccgcaccaccugguccauccacgccaagcacgaguggaugaccacggaggacaugcugaccgucuggaaccggguguggauccgcgagaaccccuggauggaggacaagacccccguggagagcugggaggagauccccuaccucggcaagcgggaggaccaguggugcgggucccugaucggccugaccagccgcgccacgugggccaagaacauccaggcggccaucaaccagguccggucccucaucgggaacgaggaguacaccgacuacaugccgagcaugaagcgcuuccggcgcgaggaggaggaggccggcgugcugugguga

SEQ ID NO: 9558 - RNA, 9876 nt, Artificial Sequence
  derived and/or modified CDS sequence (opt1) from DENV-2__EU482645__SS-prME
agcgccgggaugaucaucaugcugauccccaccgugauggccuuccaccucaccacccggaacggggagccccacaugaucgucgggauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagaagguccucaucuucauccugcugacggccguggcccccuccaugaccaugcgcugcaucggcaucagcaaccgggacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccgcaaguacugcaucgaggccaagcugaccaacacgaccaccgagagccggugccccacccagggcgagcccucccugaaggaggagcaggacaagcgcuucgugugcaagcacagcaugguggaccggggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccgcaccggccucgacuucaacgagauggugcugcugcagauggagaacaaggccuggcucgugcaccggcagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccgccugcggauggacaagcuccagcugaagggcaugagcuacuccaugugcacggggaaguucaagguggucaaggagaucgccgagacccagcacggcaccaucgugauccgcgugcaguacgagggggacggcagccccugcaagauccccuucgagaucauggaccuggagaagcgguacguccucggccgccugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcggggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccgcagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgguccgucacgcgccuggagaaccucauguggaagcagaucacccccgagcugaaccacauccuggccgagaacgaggugaagcucaccaucaugaccggggacaucaagggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggacgggcgugaccuaccuggcccugcucgcggccuucaaggugcggcccaccuucgccgccggccugcugcuccgcaagcugaccuccaaggagcugaugaugacgaccaucgggaucguccuccugagccaguccaccauccccgagaccgugcuggagcucacggacgcccuggcgcugggcaugauggugcucaagaucguccggaacauggagaaguaccagcuggccgugaccaucaugaccauccugugcgucccgaacgccgugauccuccagaacgccuggaaggugagcugcaccauccuggccgucguguccgugagcccccugcuccugacguccagccagcagaagaccgacuggaucccccuggcgcucaccaucaaggggcugaaccccaccgccaucuuccugacgacccucucccgcaccaacaagaagcgcagcuggccgcugaacgaggccaucauggccgucggcaugguguccauccuggcgagcucccuccugaagaacgacauccccaugaccggcccccugguggccgggggccuccugacggucugcuacgugcugaccgggcggagcgccgaccucgagcuggagcgcgccaccgacgugaagugggaggaccaggccgagaucuccggcagcagccccauccuguccaucaccaucagcgaggacggguccaugagcaucaagaacgaggaggaggagcagacgcucaccauccugauccggaccggccugcucgucaucuccggccuguucccgaucagcauccccaucaccgcggccgccugguaccugugggaggugaagaagcagcgcgccggggugcucugggacguccccagcccgccgcccaugggcaaggccgagcuggaggacggggcguaccggaucaagcagaagggcauccugggguacagccagaucggcgccggcguguacaaggaggggaccuuccacacgauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcccuggagcccggcaagaacccccgcgcggugcagaccaagcccgggcuguucaagaccaacacgggcaccaucggggccgugucccucgacuucagccccggcaccuccggcagccccaucaucgacaagaaggggaaggucgugggccuguacgggaacggcguggucacccgguccggcgccuacgugagcgccaucgcccagacggagaaguccaucgaggacaaccccgagaucgaggacgacaucuuccgcaagcggcgccugaccaucauggaccugcaccccggggcgggcaagaccaagcgguaccuccccgccaucgugcgcgaggccaucaagcgggggcugcgcacccugauccucgccccgacgcgggucguggcggccgagauggaggaggcccugcgcggccugcccauccgguaccagacccccgccauccgcgccgagcacaccgggcgggagaucguggaccucaugugccacgcgaccuucacgaugcgccugcugagccccguccgcgugccgaacuacaaccucaucaucauggacgaggcccacuucaccgaccccgccuccaucgccgcccggggcuacaucagcacccgcguggagaugggcgaggcggccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagaccgugugguucgugccgagcaucaaggccgggaacgacaucgcggccugccugcgcaagaacggcaagaaggucauccagcugucccggaagaccuucgacagcgaguacgugaagacgcgcaccaacgacugggacuucguggucaccaccgacaucuccgagaugggcgccaacuucaaggccgagcgggugaucgacccccgccggugcaugaagcccgugauccucacggacggggaggagcgcgucauccuggcgggccccaugccggugacccacagcuccgccgcccagcggcgcgggcggaucggccgcaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgggagaagguggacgcgaucgacggcgaguaccgccugcgcggggaggcccgcaagaccuucgucgaccucaugcgccggggcgaccugcccguguggcuggccuacaagguggccgccgaggggaucaacuacgcggaccgccgguggugcuucgacggcaucaagaacaaccagauccucgaggagaacgucgagguggagaucuggacgaaggagggggagcgcaagaagcugaagccgcgguggcuggacgcccgcaucuacuccgacccccucgcccugaaggaguucaaggaguucgccgccggccggaagucccugacccucaaccugaucaccgagaugggccgccugcccaccuucaugacgcagaagacccgggacgcgcucgacaaccuggccguccugcacaccgccgaggccgggggccgcgcguacaaccacgcccucuccgagcugcccgagacccuggagacgcuccugcugcucacccugcuggccaccgugaccgggggcaucuuccucuuccugaugagcggccgggggaucggcaagaugacccuggggaugugcugcaucaucacggccuccauccuccugugguacgcccagauccagccgcacuggaucgcggccagcaucauccuggaguucuuccucaucgugcugcugauccccgagcccgagaagcagcgcacgccccaggacaaccagcucaccuacgucgugaucgccauccugaccguggucgccgccacgauggcgaacgagaugggcuuccuggagaagaccaagaaggaccucgggcugggcuccaucgccacccagcagccggagagcaacauccuggacaucgaccuccggcccgccuccgccuggacccuguacgccguggcgacgaccuucgugacccccaugcugcgccacagcaucgagaacagcuccgucaacgugagccucaccgccaucgccaaccaggccacggugcugaugggccuggggaagggcuggccccucuccaagauggacaucggggucccgcugcuggccaucggcugcuacagccaggugaaccccaucacccucaccgcggcccugcugcuccugguggcccacuacgccaucaucgggcccggccugcaggcgaaggccacccgggaggcccagaagcgcgccgccgcgggcaucaugaagaaccccacggucgacgggaucaccgugaucgaccucgacccgauccccuacgaccccaaguucgagaagcagcugggccaggugaugcugcucauccugugcgucacccaggugcugaugaugcggaccacgugggcccucugcgaggcccugacccuggccaccgggcccaucuccacccucugggagggcaacccggggcgcuucuggaacacgaccaucgccgugagcauggcgaacaucuuccggggcuccuaccuggccggcgccgggcuccucuucagcaucaugaagaacaccaccaacacgcgccggggcaccgggaacaugggcgagacccugggcgagaaguggaagucccgccugaacgcccucggcaagagcgaguuccagaucuacaagaaguccggcauccaggaggucgaccgcacccuggccaaggaggggaucaagcggggcgagacggaccaccacgcggugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggcccggccacgaggagcccaucccgauguccaccuacggguggaaccucgugcggcugcagagcggcgucgacguguucuucaucccgcccgagaagugcgacacgcugcucugcgacaucggggaguccagccccaacccgaccguggaggccggccgcacccugcggguccugaaccucguggagaacuggcugaacaacaacacccaguucugcaucaaggugcugaaccccuacaugcccuccgucaucgagaagauggaggcccugcagcgcaaguacggcggggcgcucgugcggaacccgcugagccgcaacagcacccacgagauguacuggguguccaacgccagcggcaacaucgucuccagcgugaacaugaucucccggaugcugaucaaccgcuucacgaugcggcacaagaaggccaccuacgagcccgacguggaccucgggagcggcacccgcaacaucgggaucgaguccgagauccccaaccuggacaucaucggcaagcggaucgagaagaucaagcaggagcacgagaccagcuggcacuacgaccaggaccaccccuacaagacgugggccuaccacggcuccuacgagaccaagcagaccgggagcgccuccagcauggucaacggcguggugcgccugcucaccaagccgugggacguccugcccacggugacccagauggcgaugaccgacaccacgcccuucgggcagcagcggguguucaaggagaaggucgacacccgcacccaggagcccaaggagggcaccaagaagcugaugaagaucacggccgaguggcucuggaaggagcugggcaagaagaagaccccgcgcaugugcacccgggaggaguucacccgcaaggugcgguccaacgccgcccugggggccaucuucacggacgagaacaaguggaaguccgcgcgcgaggccguggaggacucccgguucugggagcucgucgacaaggagcgcaaccugcaccuggagggcaagugcgagaccugcguguacaacaugauggggaagcgggagaagaagcucggcgaguucgggaaggccaagggcagccgcgccaucugguacauguggcugggcgcccgguuccuggaguucgaggcgcucggguuccugaacgaggaccacugguucucccgcgagaacagccuguccggcgucgagggggagggccuccacaagcugggguacauccugcgggacgugagcaagaaggagggcggcgccauguacgccgacgacaccgccgggugggacacccgcaucacgcucgaggaccugaagaacgaggagauggugaccaaccacauggagggcgagcacaagaagcuggcggaggccaucuucaagcucaccuaccagaacaaggucgugcgggugcagcgccccacgccccgggggacggucauggacaucaucagccgccgggaccagcgcggcuccggccaggugggcaccuacggccugaacaccuucaccaacauggaggcccagcugauccggcagauggagggggagggcguguucaagaacauccagcaccucacggucaccgaggagguggccgugcagaacuggcuggcccgcgucgggcgggagcgccugagccgcauggcgaucuccggcgacgacugcguggugaagccccucgacgaccgguucgccaacgcccugaccgcccugaacgacaugggcaagauccgcaaggacauccagcagugggagccgagcaagggguggaacgacuggacccagguccccuucugcucccaccacuuccacgagcucaucaugaaggacggccgggugcuggugguccccugccgcaaccaggacgagcugaucgggcgggcccgcaucagccagggcgcgggguggucccuccgggagacggccugccugggcaagagcuacgcccagauguggucccugauguacuuccaccgccgggaccuccgccuggccgccaacgcgaucugcagcgccgugcccucccacugggugccgaccagccggaccaccugguccauccacgccaagcacgaguggaugaccacggaggacaugcugaccgucuggaaccgcguguggauccgggagaaccccuggauggaggacaagacccccguggagagcugggaggagauccccuaccucggcaagcgcgaggaccaguggugcgggucccugaucggccugaccagccgggccacgugggccaagaacauccaggcggccaucaaccagguccgcucccucaucgggaacgaggaguacaccgacuacaugccgagcaugaagcgguuccgccgggaggaggaggaggccggcgugcugugguga

SEQ ID NO: 9559 - RNA, 9876 nt, Artificial Sequence
  derived and/or modified CDS sequence (opt1) from DENV-2__EU482646__SS-prME
agcgcggggaugaucaucaugcugauccccaccgugauggccuuccaccucaccacccggaacggggagccccacaugaucgugggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucaucugcaagcacagcaugguggaccgcggcugggggaacggcugcggccuguucggcaagggcgggaucgugacgugcgccauguucacgugcaagaagaacauggagggcaagaucguccagcccgagaaccuggaguacaccaucguggugacgccccacuccggggaggagcacgcggucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggagaacaaggccuggcucgugcaccgccagugguuccuggaccugccccuccccuggcugccgggggccgacaagcaggaguccaacuggauccagaaggagacccuggugaccuucaagaacccccacgccaagaagcaggacgucgugguccucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggugaaggagaucgccgagacccagcacggcaccaucgucauccgggugcaguacgagggggacggcagccccugcaagauccccuucgagaucauggaccuggagaagcgcuacgugcucggccggcugaucaccgucaacccgaucgugacggagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccagguguucggggccaucuacggcgcggccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcguguucaccaccaacaucuggcucaagcugaaggagaagcaggacgccuucugcgacuccaagcugaugagcgccgccaucaaggacaaccgggcgguccacgccgacaugggguacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgccggccccgucagccagcacaacuaccgcccgggguaccacacccagaucgcgggccccuggcaccuggggaagcuggagauggacuucgacuucugcgacggcaccaccgugaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggucaacucccucgugaccgccggccacggccagguggacaacuucagccugggcguccugggcauggcccucuuccuggaggagaugcugcggacccgcguggggacgaagcacgcgauccuccugguggccgucuccuucgugacccugaucaccggcaacaugagcuucaaggaccucgggcggguggucgugauggugggcgccaccauggccgacgacaucgggaugggcgucacguaccuggcccugcucgcggccuucaaggugcgccccaccuucgccgccggccugcugcuccggaagcugaccuccaaggagcugaugaugaccacgaucgggaucgugcuccugagccaguccaccauccccgagaccguccuggagcucaccgacgcccuggcgcugggcaugauggugcucaagaucgugcgcaacauggagaaguaccagcuggccgucacgaucauggccauccugugcgugccgaacgccgucauccuccagaacgccuggaaggugagcugcaccauccuggcgguggucuccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcauggucuccauccuggccagcucccuccugaagaacgacauccccaugaccggcccccugguggccgggggccuccugaccgugugcuacguccugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggucaagaagcagcgggccggggugcucugggacgugcccagcccgccgcccaugggcaaggcggagcuggaggacggggccuaccgcaucaagcagaagggcauccugggguacagccagaucggcgccggcgucuacaaggaggggaccuuccacaccauguggcacgugacccggggcgccgugcucaugcacaaggggaagcgcaucgagcccuccugggccgacgucaagaaggaccugaucagcuacggcgggggcuggaagcuggagggcgaguggaaggagggggaggagguccaggugcucgcgcuggagcccggcaagaacccccgggccguccagacgaagcccgggcuguucaagaccaacaccggcaccaucggggccgugucccucgacuucagccccggcacguccggcagccccaucaucgacaagaaggggaagguggucggccuguacgggaacggcguggugacccgcuccggcgccuacgucagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcguggucgccgccgagauggaggaggcccugcggggccugcccauccgcuaccagacccccgccauccgggcggagcacacggggcgcgagaucguggaccucaugugccacgccaccuucaccaugcgccugcugagccccgugcgggucccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggucugguucgugccgagcaucaaggcggggaacgacaucgccgccugccugcggaagaacggcaagaaggugauccagcugucccgcaagaccuucgacagcgaguacgucaagacccggaccaacgacugggacuucguggugacgaccgacaucuccgagaugggcgccaacuucaaggcggagcgcgucaucgacccccggcgcugcaugaagcccgugauccucaccgacggggaggagcgggugauccuggccggccccaugccggucacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucguggaccucaugcggcgcggcgaccugcccgucuggcuggccuacaagguggccgcggaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccgugcugcacacggccgaggccggcgggcgggccuacaaccacgcccucuccgagcugcccgagacccuggagacccuccugcugcucacccugcuggccacggucaccgggggcaucuuccucuuccugaugagcggccgcgggaucggcaagaugacccuggggaugugcugcaucaccaccgccuccauccuccugugguacgcgcagauccagccgcacuggaucgccgccagcaucauccuggaguucuuccucaucgugcugcugauccccgagcccgagaagcagcggacgccccaggacaaccagcucaccuacguggucaucgccauccugaccgugguggccgcgaccauggccaacgagaugggcuuccuggagaagacgaagaaggaccucgggcugggcuccaucgccacccagcagccggagagcaacauccuggacaucgaccuccgccccgccuccgccuggacccuguacgcggucgccaccacguucgugacccccaugcugcggcacagcaucgagaacagcuccgugaacgucagccucaccgccaucgccaaccaggccaccgugcugaugggccuggggaagggcuggccccucuccaagauggacaucggggugccgcugcuggcgaucggcugcuacagccaggucaaccccaucacgcucaccgccgcccugcugcuccugguggcccacuacgcgaucaucgggcccggccugcaggccaaggccacccgcgaggcccagaagcgggccgcggccggcaucaugaagaaccccaccguggacgggaucacggucaucgaccucgacccgauccccuacgaccccaaguucgagaagcagcugggccaggugaugcugcucauccugugcgugacccagguccugaugaugcgcaccaccugggcccucugcgaggcccugacgcuggccaccgggcccaucuccacccucugggagggcaacccggggcgguucuggaacaccacgaucgcggugagcauggccaacaucuuccgcggcuccuaccuggccggcgccgggcuccucuucagcaucaugaagaacaccaccaacacccggcgcggcacggggaacaugggcgagacccugggcgagaaguggaagucccgccugaacgcccucgggaaguccgaguuccagaucuacaagcgguccggcauccaggagguggaccgcacccuggcgaaggaggggaucaagcggggcgagaccgaccaccacgccgucagccgcggguccgccaagcugcggugguucguggagcgcaacauggugacgcccgagggcaaggucguggaccucggcugcgggcggggcggguggagcuacuacugcggcgggcugaagaacgugcgcgaggucaagggccugaccaagggcgggcccggccacgaggagcccaucccgauguccaccuacggguggaaccucgugcggcugcagagcggcguggacgucuucuucaucccgcccgagaagugcgacacccugcucugcgacaucggggaguccagccccaacccgacgguggaggccggccgcacccugcgggugcugaaccucgucgagaacuggcugaacaacaacacccaguucugcaucaaggugcugaaccccuacaugcccuccgugaucgagaagauggaggcgcugcagcgcaaguacggcggggcccucguccggaacccgcugagccgcaacagcacccacgagauguacuggguguccaacgccagcggcaacaucguguccagcgucaacaugaucucccggaugcugaucaaccgcuucaccaugcggcacaagaaggccacguacgagcccgacguggaccucgggagcggcacccgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgcguccagcauggugaacggcgucgugcgccugcucaccaagccgugggacgugcugcccaccgucacgcagauggccaugaccgacaccacccccuucgggcagcagcgcguguucaaggagaagguggacacgcggacccaggagcccaaggagggcaccaagaagcugaugaagaucaccgccgaguggcucuggaaggagcugggcaagaagaagacgccgcgcaugugcacccgggaggaguucacccgcaagguccgguccaacgccgcccugggggcgaucuucaccgacgagaacaaguggaaguccgcccgcgaggccguggaggacucccgguucugggagcucguggacaaggagcgcaaccugcaccuggagggcaagugcgagacgugcgucuacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcguggagggggagggccuccacaagcugggguacauccugcgggacgucagcaagaaggagggcggcgccauguacgccgacgacaccgcggggugggacacccgcaucacccucgaggaccugaagaacgaggagauggugacgaaccacauggagggcgagcacaagaagcuggccgaggccaucuucaagcucaccuaccagaacaaggugguccgggugcagcgccccacgccccgggggaccgugauggacaucaucagccgccgggaccagcgcggcuccgggcaggucggcacguacggccugaacaccuucaccaacauggaggcccagcugauccggcagauggagggggagggcguguucaagaacauccagcaccucaccgugacggaggaggucgccgugcagaacuggcuggcgcgcguggggcgcgagcggcugagccgcauggccaucuccggcgacgacugcgucgugaagccccucgacgaccgguucgccaacgcccugaccgcccugaacgacaugggcaagauccgcaaggacauccagcagugggagccgagcaagggguggaacgacuggacccaggugcccuucugcucccaccacuuccacgagcucaucaugaaggacggccggguccugguggugcccugccgcaaccaggacgagcugaucgggcgggcgcgcaucagccagggcgccggguggucccuccgggagaccgccugccugggcaagagcuacgcccagauguggucccugauguacuuccaccgccgggaccuccgccuggccgcgaacgccaucugcagcgccguccccucccacugggugccgacgagccggaccaccugguccauccacgccaagcacgaguggaugaccaccgaggacaugcugacgguguggaaccgcgucuggauccgggagaaccccuggauggaggacaagacccccguggagagcugggaggagauccccuaccucggcaagcgcgaggaccaguggugcgggucccugaucggccugaccagccgggccaccugggcgaagaacauccaggccgccaucaaccaggugcgcucccucaucgggaacgaggaguacacggacuacaugccgagcaugaagcgguuccgccgcgaggaggaggaggccggcguccugugguga

SEQ ID NO: 9560 - RNA, 9876 nt, Artificial Sequence
  derived and/or modified CDS sequence (opt1) from DENV-2__EU482647__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagaugaagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacaucggcgagacgcugggcgagaaguggaagucccgccugaacgcccucgggaaguccgaguuccagaccuacaagaaguccggcauccaggaggucgaccggacccuggcgaaggaggggaucaagcgcggcgagaccgaccaccacgccgugagccggggguccgccaagcugcgcugguucguggagcggaacauggucacgcccgagggcaaggugguggaccucggcugcgggcgcggcggguggagcuacuacugcggcgggcugaagaacguccgggaggugaagggccugaccaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgacgguggaggccggccggacccugcgcguccugaaccucguggagaacuggcugaacaacaacacccaguucugcaucaaggugcugaaccccuacaugcccuccgucaucgagaagauggaggcgcugcagcggaaguacggcggggcccucgugcgcaacccgcugagccggaacagcacccacgagauguacuggguguccaacgccagcggcaacaucgucuccagcgugaacaugaucucccgcaugcugaucaaccgguucaccaugcgccacaagaaggccacguacgagcccgacguggaccucgggagcggcacccggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgcguccagcauggucaacggcguggugcggcugcucaccaagccgugggacguccugcccaccgugacgcagauggccaugaccgacaccacccccuucgggcagcagcgcguguucaaggagaaggucgacacgcgcacccaggagcccaaggagggcaccaagaagcugaugaagaucaccgccgaguggcucuggaaggagcugggcaagaagaagacgccgcggaugugcacccgcgaggaguucacccggaaggugcgcuccaacgccgcccugggggcgaucuucaccgacgagaacaaguggaaguccgcccgggaggccguggaggacucccgcuucugggagcucgucgacaaggagcggaaccugcaccuggagggcaagugcgagacgugcguguacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcgucgagggggagggccuccacaagcugggguacauccugcgcgacgugagcaagaaggagggcggcgccauguacgccgacgacaccgcggggugggacacccggaucacccucgaggaccugaagaacgaggagauggugacgaaccacauggagggcgagcacaagaagcuggccgaggccaucuucaagcucaccuaccagaacaaggucgugcgcgugcagcggcccacgccccgggggaccgucauggacaucaucagccggcgcgaccagcggggcuccggccagguggggacguacggccugaacaccuucaccaacauggaggcccagcugauccgccagauggagggggagggcguguucaagaacauccagcaccucaccgucacggaggagguggccgugcagaacuggcuggcgcgggucgggcgcgagcgccugagccggauggccaucuccggcgacgacugcguggugaagccccucgacgaccgcuucgccaacgcccugaccgcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccgugcccucccacugggugccgacgagccgcaccaccugguccauccacgccaagcacgaguggaugaccaccgaggacaugcugacggucuggaaccggguguggauccgcgagaaccccuggauggaggacaagacccccguggagagcugggaggagauccccuaccucggcaagcgggaggaccaguggugcgggucccugaucggccugaccagccgcgccaccugggcgaagaacauccaggccgccaucaaccagguccggucccucaucgggaacgaggaguacacggacuacaugccgagcaugaagcgcuuccggcgcgaggaggaggaggccggcgugcugugguga

SEQ ID NO: 9561 - RNA, 9876 nt, Artificial Sequence
  derived and/or modified CDS sequence (opt1) from DENV-2__EU482648__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacacgaucaccuacaagugcccccuccugcgccagaacgagcccgaggacaucgacugcuggugcaacagcaccagcaccugggugacguacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagacguggauccugcgccaccccggcuucaccaucauggcggccauccuggccuacaccaucgggaccacgcacuuccagcgggcccucaucuucauccugcugaccgcggucgcccccagcaugaccaugcgcugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccgcaaguacugcaucgaggcgaagcugacgaacaccaccaccgagucccggugcccgacgcagggcgagcccagccugaacgaggagcaggacaagcgcuucgucugcaagcacuccaugguggaccggggcugggggaacggcugcgggcuguucggcaagggcgggaucgugaccugcgccauguucacgugcaagaagaacauggagggcaagaucguccagcccgagaaccuggaguacaccaucgugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccgcaccggccucgacuucaacgagauggugcugcugcagauggaggacaaggccuggcucgugcaccggcagugguuccuggaccugccccuccccuggcugccgggggcggacacccagggcagcaacuggauccagaaggagacgcuggucaccuucaagaacccccacgccaagaagcaggacguggugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgcggagacccagcacgggacgaucgucauccgcgugcaguacgagggcgacggcucccccugcaagauccccuucgagaucauggaccuggagaagcggcacgugcucgggcgccugaucaccgucaacccgaucgugaccgagaaggacagccccgugaacaucgaggccgagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcgcuccaccagguguucggggccaucuacggcgccgccuucagcggggucuccuggaccaugaagauccugaucggcgcgaucaucacguggaucgggaugaacagccgcuccaccagccuguccgugagccuggugcucgucggcgugaucacccuguaccugggggccauggugcaggccgacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcgcacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggccaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgagaagcaggacguguucugcgacuccaagcugaugagcgcggccaucaaggacaaccgggccgugcacgccgacaugggcuacuggaucgaguccgcccucaacgacaccuggaagauggagaaggcgagcuucaucgaggucaaguccugccacuggcccaagagccacacccugugguccaacggcgugcuggagagcgagaugaucauccccaaguccuucgccgggcccgugagccagcacaacuaccgcccgggcuacuacacccagacggccgggcccuggcaccucggcaagcuggagauggacuucgacuucugcgaggggaccaccgucguggugaccgaggacugcggcaaccggggccccagccugcgcacgaccaccgccuccgggaagcucaucaccgaguggugcugccggagcugcacgcugcccccgcugcgcuaccggggcgaggacgggugcugguacggcauggagauccgcccccucaaggagaaggaggagaaccuggucaacucccuggugaccgcggggcacggccagaucgacaacuucagccucggcgugcuggggauggcccuguuccucgaggagaugcugcggacccgcgucggcaccaagcacgccauccugcucguggccguguccuucaugacgcugaucaccgggaacaugagcuuccgggaccugggccgcgucauggugauggugggggccaccaugaccgacgacaucggcaugggcgucacguaccucgcgcugcuggccgccuucaaggugcgccccaccuucgccgccgggcuccugcugcggaagcucaccuccaaggagcugaugauggcgaccaucggcaucgcccugcucagccaguccacgauccccgagaccauccuggagcugaccgacgcccucgcccuggggaugauggugcugaagaucguccgcaacauggagaaguaccagcucgccgugaccaucauggcgaucagcugcgugccgaacgccgucauccugcagaacgccuggaagguguccugcacgauccuggccgcggugagcgucagcccccuccugcugaccagcucccagcagaaggccgacuggaucccccucgcccugaccaucaagggccugaaccccaccgccaucuuccucacgacccugagccggaccuccaagaagcgcagcuggccgcugaacgaggccaucauggcggugggcaugguguccauccucgccagcagccugcugaagaacgacauccccaugaccgggccccucgucgccggcgggcugcugacggugugcuacguccucaccggccgguccgccgaccuggagcuggagcgcgccaccgacgugaagugggaggaccaggcggagaucagcggguccagccccauccucuccaucaccaucagcgaggacggcuccaugagcaucaagaacgaggaggaggagcagacgcugaccauccugauccggaccggccuccuggugaucuccgggcuguucccggucagcauccccaucaccgccgccgccugguaccucugggaggugaagaagcagcgcgccggcgugcugugggacguccccagcccgccgcccguggggaaggcggagcuggaggacggcgccuaccggaucaagcagaaggggauccucggcuacagccagaucggcgccgggguguacaaggagggcaccuuccacacgauguggcacgucacccgcggggccgugcugaugcaccggggcaagcgcaucgagcccuccugggccgacgugaagaaggaccugaucagcuacgggggcggcuggaagcucgagggggaguggaaggagggcgaggagguccaggugcuggcgcuggagcccgggaagaacccccgggccgugcagaccaagcccggccucuucaagaccaacacggggaccaucggcgccgucucccuggacuucagccccggcaccuccgggagccccaucguggaccgcaagggcaagguggucgggcuguacggcaacggcguggugacccgguccggggccuacgucagcgcgaucgcccagacggagaaguccaucgaggacaaccccgagaucgaggacgacaucuuccgcaagaagcggcucaccaucauggaccugcaccccggcgccgggaagaccaagcgcuaccugcccgccaucgugcgggaggccaucaagcgcggccugcggacccucauccuggcgccgacgcgcguggucgccgccgagauggaggaggcccugcgcgggcuccccauccgguaccagacccccgccauccgcgcggagcacaccggccgggagaucguggaccugaugugccacgccaccuucacgaugcgccugcucucccccgugcgggucccgaacuacaaccugaucaucauggacgaggcccacuucaccgaccccgccagcaucgccgcgcgcggcuacaucuccacccggguggagaugggggaggccgccggcaucuucaugaccgccacgccgcccgggagccgcgacccguucccccaguccaacgcgcccaucaucgacgaggagcgggagauccccgagcgcagcuggaacuccggccacgagugggugaccgacuucaaggggaagaccgucugguucgugccgagcaucaaggccggcaacgacaucgccgccugccugcggaagaacggcaagaaggugauccagcucucccgcaagaccuucgacagcgaguacgucaagacgcggaccaacgacugggacuucguggugaccaccgacaucuccgagaugggggccaacuucaaggcggagcgcgucaucgacccccggcgcugcaugaagcccgugauccugacggacggcgaggagcgggugauccuggccgggcccaugccggucacccacagcuccgccgcccagcgccggggccgcaucgggcgcaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgggagaagguggacgccaucgacggggaguaccgccuccggggcgaggcccgcaagaccuucguggaccugaugcggcgcggggaccugcccgucuggcucgccuaccggguggccgcggagggcaucaacuacgccgaccgccgguggugcuucgacggggugaagaacaaccagauccuggaggagaacgucgagguggagaucuggacgaaggagggcgagcgcaagaagcugaagccgcgguggcucgacgcccgcaucuacuccgacccccuggcccugaaggaguucaaggaguucgcggccggccggaagucccucacccugaaccugaucaccgagauggggcgccuccccaccuucaugacgcagaaggcccgggacgcccuggacaaccuggccgugcuccacaccgcggaggccggcgggcgcgccuacaaccacgcccuguccgagcugcccgagacccucgagacccugcugcuccugacgcugcucgccaccgucaccggcggcaucuuccuguuccugaugagcgggaagggcguggggaagaugacccucggcaugugcugcaucaucaccgcguccauccugcugugguacgcccagauccagccgcacuggaucgccgccagcaucauccucgaguucuuccugaucgugcugcucauccccgagcccgagaagcagcggacgccccaggacaaccagcugaccuacgucgugaucgccauccugaccgucguggcggccaccauggccaacgagaugggguuccucgagaagacgaagaaggaccugggccugggcagcaucgccacccaggagccggaguccaacauccucgacaucgaccugcgccccgccagcgcguggacccuguacgccguggccaccacguucgucacccccaugcuccggcacuccaucgagaacagcuccgugaacgugagccugaccgccaucgcgaaccaggccaccguccugauggggcucggcaagggguggccccuguccaagauggacaucggcgugccgcugcucgccaucgggugcuacagccaggugaaccccaucacgcugaccgccgcccugcuccugcugaucgcgcacuacgccaucaucggccccggccuccaggccaaggccacccgcgaggcccagaagcgggcggccgccgggaucaugaagaaccccaccgucgacggcaucacggugaucgaccuggacccgauccccuacgaccccaaguucgagaagcagcugggccaggugaugcuccugauccugugcgucacccaggugcucaugaugcgcaccaccugggcccugugcgaggcccugacgcucgcgaccggccccaucuccacccugugggaggggaacccgggccgcuucuggaacaccacgaucgccgugagcauggccaacaucuuccggggcuccuaccuggccggggcgggccuccuguucagcaucaugaagaacaccaccaacacccgccgggggacgggcaacaucggcgagacccugggggagaaguggaagucccgccucaacgcccugggcaagagcgaguuccagaucuacaagaaguccgggauccaggaggucgaccggacccuggccaaggagggcaucaagcgcggggagaccgaccaccacgccgugagccggggcuccgccaagcuccgcugguucguggagcggaacauggucacgcccgagggcaaggugguggaccuggggugcggccgcgggggcuggagcuacuacugcgggggccugaagaacguccgggaggugaagggccucaccaagggcggccccgggcacgaggagcccaucccgauguccaccuacggcuggaaccuggugcgccugcagagcggggucgacguguucuucacgccgcccgagaagugcgacacgcuccugugcgacaucggcgagagcucccccaacccgaccaucgaggcgggccggacccugcgcgugcucagccuggucgagaacuggcugaacaacgacacccaguucugcaucaaggugcucaaccccuacaugcccuccgugaucgagaagauggagacccugcagcggaaguacgggggcgcccugguccgcaacccgcugagccggaacuccacgcacgagauguacugggugagcaacgccaccgggaacaucguguccagcgucaacaugaucucccgcaugcucaucaaccgguucaccaugaagcacaagaaggccaccuacgagcccgacguggaccugggcagcgggacgcgcaacaucggcaucgaguccgagauccccaaccuggacaucaucggcaagcgcaucgagaagaucaagcaggagcacgagaccagcuggcacuacgaccaggaccaccccuacaagaccugggccuaccacggguccuacgagaccaagcagacgggcagcgcguccagcauggugaacggggucgugcggcuccugaccaagccgugggacgugguccccauggugacccagauggccaugaccgacacgacccccuucggccagcagcgcguguucaaggagaaggucgacacccggacccaggagcccaaggagggcacgaagaagcugaugaagaucaccgccgaguggcucuggaaggagcuggggaagaagaagaccccgcgcaugugcacccgggaggaguucacgcgcaaggugcgguccaacgccgcccugggcgcgaucuucaccgacgagaacaaguggaaguccgcccgcgaggccguggaggacucccgguucugggagcucgucgacaaggagcgcaaccugcaccuggaggggaagugcgagaccugcguguacaacaugaugggcaagcgggagaagaagcucggggaguucggcaaggccaagggcagccgcgcgaucugguacauguggcugggggcccgguuccuggaguucgaggcccucggcuuccugaacgaggaccacugguucagccgcgagaacucccugagcgggguggagggcgaggggcuccacaagcugggcuacauccugcgggacgucuccaagaaggagggcggggccauguacgccgacgacaccgcgggcugggacacgcgcaucacccucgaggaccugaagaacgaggagauggugaccaaccacauggagggggagcacaagcggcuggccgaggccaucuucaagcucaccuaccagaacaaggugguccgcgugcagcggcccacgccccgcggcaccgucauggacaucaucagccggcgcgaccagcgcggguccggccaggugggcaccuacgggcugaacaccuucacgaacauggaggcccagcugauccggcagauggagggcgaggggaucuucaagagcauccagcaccucaccgugaccgaggagaucgccguccagaacuggcuggcgcgcgugggccgggagcgccugucccggauggccaucagcggcgacgacugcguggucaagccccucgacgaccgcuucgccuccgcccugaccgcccugaacgacauggggaaggugcggaaggacauccagcagugggagccgagcaagggcuggaacgacuggacccaggugcccuucugcucccaccacuuccacgagcucaucaugaaggacgggcgcguccugguggugcccugccggaaccaggacgagcugaucggccgcgcgcggaucagccagggggccggcuggucccucaaggagaccgccugccugggcaagagcuacgcccagauguggucccugauguacuuccaccgccgggaccuccgccuggccgcgaacgccaucugcagcgccguccccucccacugggugccgaccagccggaccaccuggagcauccacgccaagcacgaguggaugacgaccgaggacaugcugaccguguggaaccgcgucuggauccaggagaaccccuggauggaggacaagacccccguggaguccugggaggaggugcccuaccucgggaagcgggaggaccaguggugcggcagccugaucgggcugacgucccgcgcgaccugggccaagaacauccagaccgccaucaaccagguccggagccucaucggcaacgaggaguacaccgacuacaugccguccaugaagcgcuuccgccgggaggaggaggaggccggggugcugugguga

SEQ ID NO: 9562 - RNA, 9876 nt, Artificial Sequence
  derived and/or modified CDS sequence (opt1) from DENV-2__EU482649__SS-prME
agcgcgggcaugaucaucaugcugauccccaccgugauggccuuccaccucaccacccggaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcgcagcgucgcccuggugccccacguggggaugggccucgagacgcggaccgagaccuggaugagcagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccaucgcccccuccaugaccaugcggugcaucggcaucagcaaccgcgacuucguggagggcguguccgggggcagcugggucgacaucgugcucgagcacggguccugcgugaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcggccuguucggcaagggcgggaucgugacgugcgccauguucacgugcaagaagaacauggagggcaagaucguccagcccgagaaccuggaguacaccaucguggugacgccccacuccggggaggagcacgcggucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggagaacaaggccuggcucgugcaccgccagugguuccuggaccugccccuccccuggcugccgggggccgacaagcaggaguccaacuggauccagaaggagacccuggugaccuucaagaacccccacgccaagaagcaggacgucgugguccucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggugaaggagaucgccgagacccagcacggcaccaucgucauccgggugcaguacgagggggacggcagccccugcaagauccccuucgagaucauggaccuggagaagcgcuacgugcucggccggcugaucaccgucaacccgaucgugacggagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccagguguucggggccaucuacggcgcggccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcguguucaccaccaacaucuggcucaagcugaaggagaagcaggacgccuucugcgacuccaagcugaugagcgccgccaucaaggacaaccgggcgguccacgccgacaugggguacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgccggccccgucagccagcacaacuaccgcccgggguaccacacccagaucgcgggccccuggcaccuggggaagcuggagauggacuucgacuucugcgacggcaccaccgugaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggucaacucccucgugaccgccggccacggccagguggacaacuucagccugggcguccugggcauggcccucuuccuggaggagaugcugcggacccgcguggggacgaagcacgcgauccuccugguggccgucuccuucgugacccugaucaccggcaacaugagcuucaaggaccucgggcggguggucgugauggugggcgccaccauggccgacgacaucgggaugggcgucuccuaccuggcccugcucgcggccuucaaggugcgccccacguucgccgccggccugcugcuccggaagcugaccagcaaggagcugaugaugaccaccaucgggaucgugcuccugucccagagcacgauccccgagaccguccuggagcucaccgacgcccuggcgcugggcaugauggugcucaagaucgugcgcaacauggagaaguaccagcuggccgucaccaucauggccauccugugcgugccgaacgccgucgugcuccagaacgccuggaagguguccugcacgauccuggcggucgugagcgugagcccccugcuccugaccagcucccagcagaagaccgacuggaucccccuggcccucaccaucaaggggcugaaccccacggccaucuuccugaccacccucagccgcaccaacaagaagcgguccuggccgcugaacgaggccaucauggcggucggcauggugagcauccuggccuccagccuccugaagaacgacauccccaugacgggcccccugguggccgggggccuccugaccgucugcuacgugcugaccgggcgcuccgccgaccucgagcuggagcgggccaccgacgugaagugggaggaccaggcggagaucagcggcagcucccccauccugagcaucacgaucuccgaggacgggagcauguccaucaagaacgaggaggaggagcagacccucaccauccugauccgcaccggccugcucgucaucagcggccuguucccgaucuccauccccaucacggccgccgccugguaccugugggaggugaagaagcagcgggccggggugcucugggacguccccuccccgccgcccaugggcaaggcggagcuggaggacggggccuaccgcaucaagcagaagggcauccugggguacucccagaucggcgccggcguguacaaggaggggaccuuccacaccauguggcacgugacccggggcgccguccucaugcacaaggggaagcgcaucgagcccagcugggccgacgugaagaaggaccugaucuccuacggcgggggcuggaagcuggagggcgaguggaaggagggggaggaggugcagguccucgcgcuggagcccggcaagaacccccgggccgugcagaccaagcccgggcuguucaagacgaacaccggcaccaucggggccgugagccucgacuucucccccggcaccagcggcucccccaucaucgacaagaaggggaaggucgugggccuguacgggaacggcguggucacgcgcagcggcgccuacguguccgccaucgcgcagaccgagaaguccaucgaggacaaccccgagaucgaggacgacaucuuccggaagcgccggcugaccaucauggaccugcaccccggggccggcaagaccaagcgcuaccuccccgccaucgugcgggaggccaucaagcgcgggcugcggacgcugauccucgcgccgacccgcgucguggccgccgagauggaggaggcccugcggggccugcccauccgcuaccagacccccgccaucaaggcggagcacaccgggcgggagaucguggaccucaugugccacgccacguucaccaugcgccugcugucccccguccgcgugccgaacuacaaccucaucaucauggacgaggcccacuucaccgaccccgccagcaucgccgcgcggggcuacaucagcacccgcguggagaugggcgaggccgccgggaucuucaugacggccacgccgcccggcucccgggacccguucccccagagcaacgcccccaucaucgacgaggagcgcgagauccccgagcgguccuggaacagcgggcacgagugggucaccgacuucaagggcaagaccgugugguucgugccguccaucaaggcggggaacgacaucgccgccugccugcgcaagaacggcaagaaggucauccagcugagccggaagacguucgacuccgaguacgugaagacccgcaccaacgacugggacuucguggucaccacggacaucagcgagaugggcgccaacuucaaggcggagcgggugaucgacccccgccggugcaugaagcccgugauccucaccgacggggaggagcgcgucauccuggccggccccaugccggugacccacuccagcgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgggagaagguggacgccaucgacggcgaguaccgccugcgcggggaggcccgcaagacguucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccacguucaugacccagaagacccgggacgcccucgacaaccuggccguccugcacaccgccgaggccggcgggcgcgccuacaaccacgcccucagcgagcugcccgagacgcuggagacccuccugcugcucacccugcuggccaccgugaccggcgggaucuuccucuuccugauguccgggcgggggaucgggaagaugacccuggggaugugcugcaucaucaccgccagcauccuccugugguacgcgcagauccagccgcacuggaucgccgccuccaucauccuggaguucuuccucaucgugcugcugauccccgagcccgagaagcagcgcacgccccaggacaaccagcucaccuacgucgugaucgccauccugacgguggucgccgcgaccauggccaacgagaugggcuuccuggagaagaccaagaaggaccucgggcugggcagcaucgccacccagcagccggaguccaacauccuggacaucgaccuccggcccgccagcgccuggacgcuguacgcgguggccaccaccuucgugacccccaugcugcgccacagcaucgagaacuccagcgucaacgugucccucacggccaucgccaaccaggccaccgugcugaugggccuggggaagggcuggccccucagcaagauggacaucggggucccgcugcuggcgaucggcugcuacucccaggugaaccccaucacccucaccgccgcccugcugcuccugguggcccacuacgcgaucaucgggcccggccugcaggccaaggccacgcgggaggcccagaagcgcgccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcggacgaccugggcccucugcgaggcccugacccuggccaccgggcccaucagcacgcucugggagggcaacccggggcgcuucuggaacaccaccaucgcgguguccauggccaacaucuuccggggcagcuaccuggccggcgccgggcuccucuucuccaucaugaagaacaccacgaacacccgccggggcaccgggaacaucggcgagacccugggcgagaaguggaagucccgccugaacgcccucgggaaguccgaguuccagaucuacaagaaguccggcauccaggaggucgaccgcacgcuggcgaaggaggggaucaagcggggcgagaccgaccaccacgccgugucccgcgggagcgccaagcugcggugguucguggagcgcaacauggucacccccgagggcaaggugguggaccucggcugcgggcggggcgggugguccuacuacugcggcgggcugaagaacguccgcgaggugaagggccugaccaagggcgggcccggccacgaggagcccaucccgaugagcacguacggguggaaccucgugcggcugcaguccggcgucgacguguucuucaucccgcccgagaagugcgacacccugcucugcgacaucggggagagcucccccaacccgaccguggaggccggccgcacccugcggguccugaaccucguggagaacuggcugaacaacaacacgcaguucugcaucaaggugcugaaccccuacaugcccagcgucaucgagaagauggaggcgcugcagcgcaaguacggcggggcccucgugcggaacccgcugagccgcaacuccacccacgagauguacugggugagcaacgccuccggcaacaucgucagcuccgugaacaugaucagccggaugcugaucaaccgcuucaccaugcggcacaagaaggccaccuacgagcccgacguggaccucggguccggcacccgcaacaucgggaucgagagcgagauccccaaccuggacaucaucggcaagcggaucgagaagaucaagcaggagcacgagacguccuggcacuacgaccaggaccaccccuacaagaccugggccuaccacggcagcuacgagaccaagcagaccggguccgcgagcuccauggucaacggcguggugcgccugcucacgaagccgugggacguccugcccaccgugacccagauggccaugaccgacacgacccccuucgggcagcagcggguguucaaggagaaggucgacacccgcacccaggagcccaaggagggcacgaagaagcugaugaagaucaccgccgaguggcucuggaaggagcugggcaagaagaagaccccgcgcaugugcacccgggaggaguucacgcgcaaggugcggagcaacgccgcccugggggcgaucuucaccgacgagaacaaguggaaguccgcccgcgaggccguggaggacagccgguucugggagcucgucgacaaggagcgcaaccugcaccuggagggcaagugcgagaccugcguguacaacaugauggggaagcgggagaagaagcucggcgaguucgggaaggccaagggcucccgcgccaucugguacauguggcugggcgcgcgguuccuggaguucgaggcccucggguuccugaacgaggaccacugguucagccgcgagaacucccugagcggcgucgagggggagggccuccacaagcugggguacauccugcgggacgugagcaagaaggagggcggcgccauguacgccgacgacaccgcggggugggacacgcgcaucacccucgaggaccugaagaacgaggagauggugaccaaccacauggagggcgagcacaagaagcuggccgaggccaucuucaagcucaccuaccagaacaaggucgugcgggugcagcgccccacgccccgggggaccgucauggacaucaucucccgccgggaccagcgcggcagcggccagguggggaccuacggccugaacaccuucacgaacauggaggcccagcugauccggcagauggagggggagggcguguucaagaacauccagaaccucaccgucaccgaggagguggccgugcagaacuggcuggcgcgcgucgggcgggagcgccugucccgcauggccaucagcggcgacgacugcguggugaagccccucgacgaccgguucgccaacgcccugaccgcccugaacgacaugggcaagauccgcaaggacauccagcagugggagccguccaagggguggaacgacuggacgcagguccccuucugcagccaccacuuccacgagcucaucaugaaggacggccgggugcuggugguccccugccgcaaccaggacgagcugaucgggcgggcgcgcaucucccagggcgccggguggagccuccgggagaccgccugccugggcaaguccuacgcccagauguggagccugauguacuuccaccgccgggaccuccgccuggccgcgaacgccaucugcuccgccgugcccagccacugggugccgaccucccggaccacguggagcauccacgccaagcacgaguggaugaccaccgaggacaugcugaccgucuggaaccgcguguggauccgggagaaccccuggauggaggacaagacccccguggaguccugggaggagauccccuaccucggcaagcgcgaggaccaguggugcgggagccugaucggccugacgucccgggccaccugggcgaagaacauccaggccgccaucaaccagguccgcagccucaucgggaacgaggaguacaccgacuacaugccgagcaugaagcgguuccgccgggaggaggaggaggccggcgugcugugguga

SEQ ID NO: 9563 - RNA, 9876 nt, Artificial Sequence
  derived and/or modified CDS sequence (opt1) from DENV-2__EU482650__SS-prME
agcgcgggcaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggaaguucuggaacaccaccaucgcggugagcauggccaacaucuuccggggcuccuaccuggccggcgccgggcuccucuucagcaucaugaagaacacgaccaacacccgccggggcaccgggaacaugggcgagacgcugggcgagaaguggaagucccgccugaacacccucgggaaguccgaguuccagaucuacaagaaguccggcauccaggaggucgaccgcacccuggccaaggaggggaucaagcggggcgagaccgaccaccacgcggugagccgcggguccgccaagcugcggugguucguggagcgcaacauggucacgcccgagggcaaggugguggaccucggcugcgggcggggcggguggagcuacuacugcggcgggcugaagaacguccgcgaggugaagggccugaccaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgacgguggaggccggccgcacccugcggguccugaaccucguggagaacuggcugaacaacaacacccaguucugcaucaaggugcugaaccccuacaugcccuccgucaucgagaagauggaggcccugcagcgcaaguacggcggggcgcucgugcggaacccgcugagccgcaacagcacccacgagauguacuggguguccaacgccagcggcaacaucgucuccagcgugaacaugaucucccggaugcugaucaaccgcuucaccaugcggcacaagaaggccacguacgagcccgacguggaccucgggagcggcacccgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggucaacggcguggugcgccugcucaccaagccgugggacguccugcccaccgugacgcagauggcgaugaccgacaccacccccuucgggcagcagcggguguucaaggagaaggucgacacgcgcacccaggagcccaaggagggcaccaagaagcugaugaagaucaccgccgaguggcucuggaaggagcugggcaagaagaagacgccgcgcaugugcacccgggaggaguucacccgcaaggugcgguccaacgccgcccugggggccaucuucaccgacgagaacaaguggaaguccgcgcgcgaggccguggaggacucccgguucugggagcucgucgacaaggagcgcaaccugcaccuggagggcaagugcgagacgugcguguacaacaugauggggaagcgggagaagaagcucggcgaguucgggaaggccaagggcagccgcgccaucugguacauguggcugggcgcccgguuccuggaguucgaggcgcucggguuccugaacgaggaccacugguucucccgcgagaacagccuguccggcgucgagggggagggccuccacaagcugggguacauccugcgggacgugagcaagaaggagggcggcgccauguacgccgacgacaccgccgggugggacacccgcaucacccucgaggaccugaagaacgaggagauggugacgaaccacauggagggcgagcacaagaagcuggcggaggccaucuucaagcucaccuaccagaacaaggucgugcgggugcagcgccccacgccccgggggaccgucauggacaucaucagccgccgggaccagcgcggcuccggccagguggggacguacggccugaacaccuucaccaacauggaggcccagcugauccggcagauggagggggagggcguguucaagaacauccagcaccucaccgucacggaggagguggccgugcagaacuggcuggcccgcgucgggcgggagcgccugagccgcauggcgaucuccggcgacgacugcguggugaagccccucgacgaccgguucgccaacgcccugaccgcccugaacgacaugggcaagauccgcaaggacauccagcagugggagccgagcaagggguggaacgacuggacccagguccccuucugcucccaccacuuccacgagcucaucaugaaggacggccgggugcuggugguccccugccgcaaccaggacgagcugaucgggcgggcccgcaucagccagggcgcgggguggucccuccgggagaccgccugccugggcaagagcuacgcccagauguggucccugauguacuuccaccgccgggaccuccgccuggccgccaacgcgaucugcagcgccgugcccucccacugggugccgacgagccggaccaccugguccauccacgccaagcacgaguggaugaccaccgaggacaugcugacggucuggaaccgcguguggauccgggagaaccccuggauggaggacaagacccccguggagagcugggaggagauccccuaccucggcaagcgcgaggaccaguggugcgggucccugaucggccugaccagccgggccaccugggccaagaacauccaggcggccaucaaccagguccgcucccucaucgggaacgaggaguacacggacuacaugccgagcaugaagcgguuccgccgggaggaggaggaggccggcgugcugugguga

SEQ ID NO: 9564 - RNA, 9876 nt, Artificial Sequence
  derived and/or modified CDS sequence (opt1) from DENV-2__EU482651__SS-prME
agcgcggggaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcuccggcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucaccggccccuggcaccuggggaagcuggagauggacuucgacuucugcgacggcaccacggugaucgucaccgaggacugcgggaaccgcggccccucccuccggaccaccacggcgagcggcaagcugaucaccgaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacgcggguggggaccaagcacgccauccuccuggucaccguguccuucgugacccugaucacgggcaacaugagcuucaaggaccucgggcgcgucguggugauggucggcgcgaccauggccgacgacaucgggaugggcgugaccuaccuggcccugcucgccgccuucaaggugcggcccaccuucgcggccggccugcugcuccgcaagcugacguccaaggagcugaugaugaccaccaucgggaucguccuccugagccaguccaccauccccgagacggugcuggagcucaccgacgcccuggcccugggcaugauggugcucaagaucguccgcaacauggagaaguaccagcuggccgugaccaucauggcgauccugugcgucccgaacgccguggugcuccagaacgccuggaaggucagcugcaccauccuggccgugguguccgucagcccccugcuccugacguccagccagcagaagaccgacuggaucccccuggcccucaccaucaaggggcugaaccccaccgcgaucuuccugacgacccucucccggaccaacaagaagcgcagcuggccgcugaacgaggccaucauggccgugggcaugguguccauccuggccagcucccuccugaagaacgacauccccaugaccggcccccuggucgccggcgggcuccugacggugugcuacgugcugaccgggcggagcgccgaccucgagcuggagcgcgccaccgacgucaagugggaggaccaggccgagaucuccgggagcagccccauccuguccaucaccaucagcgaggacggguccaugagcaucaagaacgaggaggaggagcagacgcucaccauccugauccggaccggccugcucgugaucuccggccuguucccgaucagcauccccaucaccgccgcggccugguaccugugggaggugaagaagcagcgcgccgggguccucugggacgugcccagcccgccgcccaugggcaaggccgagcuggaggacggggccuaccggaucaagcagaagggcauccugggguacagccagaucggcgcgggcguguacaaggaggggaccuuccacacgauguggcacgucacccgcggcgccgugcucaugcacaaggggaagcggaucgagcccuccugggccgacgugaagaaggaccugaucagcuacggcgggggcuggaagcuggagggcgaguggaaggagggggaggagguccaggugcucgcccuggagcccggcaagaacccccgcgccgugcagaccaagcccgggcuguucaagaccaacacgggcaccaucggggcggucucccucgacuucagccccggcaccuccggcagccccaucaucgacaagaaggggaagguggugggccuguacgggaacggcgucgugacccgguccggcgccuacgugagcgccaucgcccagacggagaaguccaucgaggacaaccccgagaucgaggacgacaucuuccgcaagcggcgccugaccaucauggaccugcaccccggggccggcaagaccaagcgguaccuccccgcgaucguccgcgaggccaucaagcgggggcugcgcacccugauccucgccccgacgcgggugguggccgcggagauggaggaggcccugcgcggccugcccauccgguaccagacccccgccaucaaggccgagcacaccgggcgcgagaucgucgaccucaugugccacgccaccuucacgaugcgccugcugagccccgugcgggugccgaacuacaaccucaucaucauggacgaggcgcacuucaccgaccccgccuccaucgccgcccgcggcuacaucagcacccgggucgagaugggcgaggccgcggggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagaccgugugguucgucccgagcaucaaggccgggaacgacaucgccgcgugccugcggaagaacggcaagaaggugauccagcugucccgcaagaccuucgacagcgaguacgugaagacgcggaccaacgacugggacuucgucgugaccaccgacaucuccgagaugggcgccaacuucaaggccgagcgcgugaucgacccccggcgcugcaugaagcccgucauccucacggacggggaggagcgggugauccuggccggccccaugccggugacccacagcuccgcggcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaaggucgacgccaucgacggcgaguaccggcugcgcggggaggcgcgcaagaccuucguggaccucaugcggcgcggcgaccugcccguguggcuggccuacaaggucgccgccgaggggaucaacuacgccgaccggcgcuggugcuucgacggcaucaagaacaaccagauccucgaggagaacguggaggucgagaucuggacgaaggagggggagcggaagaagcugaagccgcgcuggcuggacgcgcggaucuacuccgacccccucgcccugaaggaguucaaggaguucgccgccggccgcaagagccugacccucaaccugaucaccgagaugggccggcugcccaccuucaugacgcagaagacccgcgacgcccucgacaaccuggcggugcugcacaccgccgaggccgggggccgggccuacaaccacgcgcucuccgagcugcccgagacccuggagacgcuccugcugcucacccugcuggccaccgugaccgggggcaucuuccucuuccugaugagcggccgcgggaucggcaagaugacccuggggaugugcugcaucaucacggccuccauccuccugugguacgcccagauccagccgcacuggaucgccgcgagcaucauccuggaguucuuccucaucguccugcugauccccgagcccgagaagcagcggacgccccaggacaaccagcucaccuacguggugaucgccauccugaccgucguggccgccacgauggccaacgagaugggcuuccuggagaagaccaagaaggaccucgggcugggcuccaucgcgacccagcagccggagagcaacauccuggacaucgaccuccgccccgccuccgccuggacccuguacgccguggccacgaccuucgucacccccaugcugcggcacagcaucgagaacagcuccgugaacgugagccucaccgcgaucgccaaccaggccacgguccugaugggccuggggaagggcuggccccucuccaagauggacaucggggugccgcugcuggccaucggcugcuacagccaggugaaccccaucacccucaccgccgcgcugcugcuccuggucgcccacuacgccaucaucgggcccggccugcaggccaaggcgacccgcgaggcccagaagcgggccgccgccggcaucaugaagaaccccacgguggacgggaucaccgugaucgaccucgacccgauccccuacgaccccaaguucgagaagcagcugggccaggucaugcugcucauccugugcgugacccaggugcugaugaugcgcaccacgugggcgcucugcgaggcccugacccuggccaccgggcccaucuccacccucugggagggcaacccggggcgguucuggaacacgaccaucgccgucagcauggccaacaucuuccgcggcuccuaccuggcgggcgccgggcuccucuucagcaucaugaagaacaccaccaacacgcggcgcggcaccgggaacaucggcgagacccugggcgagaaguggaagucccgccugaacgcccucgggaaguccgaguuccagaucuacaagaaguccggcauccaggagguggaccggacccuggccaaggaggggaucaagcgcggcgagacggaccaccacgccgugagccggggguccgcgaagcugcgcugguucgucgagcggaacauggugacccccgagggcaagguggucgaccucggcugcgggcgcggcggguggagcuacuacugcggcgggcugaagaacgugcgggaggugaagggccugaccaagggcgggcccggccacgaggagcccaucccgauguccaccuacggguggaaccucguccgccugcagagcggcguggacguguucuucaucccgcccgagaagugcgacacgcugcucugcgacaucggggaguccagccccaacccgaccgucgaggccggccggacccugcgcgugcugaaccucguggagaacuggcugaacaacaacacccaguucugcaucaagguccugaaccccuacaugcccuccgugaucgagaagauggaggcccugcagcggaaguacggcggggcccucgugcgcaacccgcugagccggaacagcacccacgagauguacugggucuccaacgcgagcggcaacaucguguccagcgugaacaugaucucccgcaugcugaucaaccgguucacgaugcgccacaagaaggccaccuacgagcccgacgucgaccucgggagcggcacccggaacaucgggaucgaguccgagauccccaaccuggacaucaucggcaagcgcaucgagaagaucaagcaggagcacgagaccagcuggcacuacgaccaggaccaccccuacaagacgugggccuaccacggcuccuacgagaccaagcagaccgggagcgccuccagcauggugaacggcgugguccggcugcucaccaagccgugggacgugcugcccacggugacccagauggccaugaccgacaccacgcccuucgggcagcagcgcgucuucaaggagaagguggacacccgcacccaggagcccaaggagggcaccaagaagcugaugaagaucacggcggaguggcucuggaaggagcugggcaagaagaagaccccgcggaugugcacccgcgaggaguucacccggaaggugcgcuccaacgccgcccugggggccaucuucacggacgagaacaaguggaaguccgcccgggaggcggucgaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcccgcuuccuggaguucgaggcccucggguuccugaacgaggaccacugguucucccgggagaacagccuguccggcguggagggggagggccuccacaagcugggguacauccugcgcgacgugagcaagaaggagggcggcgcgauguacgccgacgacaccgccgggugggacacccggaucacgcucgaggaccugaagaacgaggagauggucaccaaccacauggagggcgagcacaagaagcuggccgaggcgaucuucaagcucaccuaccagaacaagguggugcgcguccagcggcccacgccccgcgggacggugauggacaucaucagccggcgcgaccagcggggcuccggccaggugggcaccuacggccugaacaccuucaccaacauggaggcccagcugauccgccagauggagggggagggcgucuucaagaacauccagcaccucacggugaccgaggagguggccguccagaacuggcuggcccggguggggcgcgagcgccugagccggauggccaucuccggcgacgacugcguggucaagccccucgacgaccgcuucgcgaacgcccugaccgcccugaacgacaugggcaagauccggaaggacauccagcagugggagccgagcaagggguggaacgacuggacccaggugcccuucugcucccaccacuuccacgagcucaucaugaaggacggccgcgugcuggucgugcccugccggaaccaggacgagcugaucgggcgcgcccggaucagccagggcgccggguggucccuccgcgagacggcgugccugggcaagagcuacgcccagauguggucccugauguacuuccaccggcgcgaccuccggcuggccgccaacgccaucugcagcgcggugcccucccacugggucccgaccagccgcaccaccugguccauccacgccaagcacgaguggaugaccacggaggacaugcugaccguguggaaccggguguggauccgcgagaaccccuggauggaggacaagacccccgucgagagcugggaggagauccccuaccucggcaagcgggaggaccaguggugcgggucccugaucggccugaccagccgcgccacgugggccaagaacauccaggccgcgaucaaccaggugcggucccucaucgggaacgaggaguacaccgacuacaugccgagcaugaagcgcuuccggcgcgaggaggaggaggccggcgugcugugguga

SEQ ID NO: 9565 - RNA, 9876 nt, Artificial Sequence
  derived and/or modified CDS sequence (opt1) from DENV-2__EU482652__SS-prME
agcgcggggaugaucaucaugcugauccccaccgugauggccuuccaccucaccacccggaacggggagccgcacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacgcggaccgagaccuggauguccagcgagggggccuggaagcacgcccagcgcaucgagaccuggauccugcggcaccccggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugcccgacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacucccugugcacggggaaguucaagguggucaaggagaucgccgagacccagcacggcaccaucgugauccgggugcaguacgagggggacggcagccccugcaagauccccuucgagaucauggaccucgagaagcgcuacguccugggccggcugaucaccgugaacccgaucgugacggagaaggacucccccgucaacaucgaggccgagccgcccuucggggacagcuacaucaucaucggcguggagccggggcagcucaagcugaacugguucaagaagggcuccagcaucgggcagauguucgagaccaccaugcgcggcgcgaagcgcauggccauccugggcgacaccgccugggacuucgggucccucggcgggguguucacgagcaucggcaaggcccugcaccaggucuucggggccaucuacggcgcggccuucuccggcgugagcuggaccaugaagauccugaucggggugaucaucaccuggaucggcaugaacucccggagcaccucccugagcgucucccucgugcugguggggaucgucacgcuguaccucggcgugauggugcaggccgacagcgggugcgucguguccuggaagaacaaggagcugaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcucgagaaccugauguggaagcagaucacccccgagcugaaccacauccucgccgagaacgaggugaagcugaccaucaugaccggggacaucaagggcaucaugcaggccgggaagcgcagccugcggccgcagcccacggagcucaaguacuccuggaagaccuggggcaaggccaagaugcugagcaccgaguccuacaaccagaccuuccugaucgacggccccgagacggcggagugcccgaacaccaaccgcgccuggaacagccucgagguggaggacuacggguucggcgucuucaccaccaacaucuggcugaagcugaaggagaagcaggacgccuucugcgacuccaagcucaugagcgccgccaucaaggacaaccgggcggugcacgccgacaugggguacuggaucgaguccgcccugaacgacacguggaagaucgagaaggccagcuucaucgaggugaagaacugccacuggcccaagucccacacccuguggagcaacggcguccucgaguccgagaugaucauccccaagaaccuggccggccccgugagccagcacaacuaccgcccgggguaccacacccagaucgcgggccccuggcaccuggggaagcucgagauggacuucgacuucugcgacggcaccaccgugaucgucacggaggacugcgggaaccggggccccucccugcgcaccaccaccgccagcggcaagcugaucacggaguggugcugccggagcugcacccucccgccccugcgcuaccgcggggaggacggcugcugguacgggauggagauccgcccccugaaggagaaggaggagaaccucgugaacucccuggugaccgccggccacgggcaggucgacaacuucagccugggcgugcucggcauggcccuguuccuggaggagaugcuccggacccgcguggggacgaagcacgcgauccugcuggucgccguguccuucgugacccucaucaccggcaacaugagcuucaaggaccuggggcgggucguggugauggucggcgccaccaugacggacgacaucgggaugggcgugaccuaccuggcccuccuggccgcguucaaggugcgccccaccuucgccgccggccugcuccugcggaagcugaccuccaaggagcucaugaugacgaccaucgggaucguccugcugagccaguccgccauccccgagaccgugcucgagcugaccgacgcccuggcgcucggcaugauggugcugaagaucguccgcaacauggagaaguaccagcuggccgugacgaucauggccauccucugcguccccaacgccgugauccugcagaacgccuggaaggugagcugcaccauccuggcggucguguccgugagcccccuccugcugaccuccagccagcagaagaccgacuggaucccccucgcccugacgaucaaggggcugaaccccaccgccaucuuccucaccacccugucccgcacgaacaagaagcggagcuggccgcugaacgaggccaucauggcggucggcaugguguccauccucgccagcucccugcugaagaacgacauccccaugaccggcccccucguggccgggggccugcugaccgucugcuacgugcucaccgggcgcagcgccgaccuggagcuggagcgggccacggacgugaagugggaggaccaggcggagaucuccggcagcagccccauccucuccaucaccaucagcgaggacggguccaugagcaucaagaacgaggaggaggagcagacccugaccauccugauccgcacgggccuccuggucaucuccggccuguucccgaucagcauccccaucaccgccgccgccugguaccucugggaggugaagaagcagcgggccggggugcugugggacguccccagcccgccgcccaugggcaaggcggagcuggaggacggggccuaccgcaucaagcagaagggcauccucggguacagccagaucggcgccggcguguacaaggaggggaccuuccacaccauguggcacgugacccggggcgccguccugaugcacaaggggaagcgcaucgagcccuccugggccgacgugaagaaggaccugaucagcuacggcgggggcuggaagcucgagggcgaguggaaggagggggaggaggugcagguccuggcgcuggagcccggcaagaacccccgggccgugcagacgaagcccggccucuucaagaccaacaccggcaccaucggggccgugucccuggacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccuccaccccggggccggcaagacgaagcgcuaccugcccgccaucgugcgggaggccaucaagcgcgggcugcggacccucauccuggcgccgacccgcgucguggccgccgagauggaggaggcccugcggggccuccccauccgcuaccagacccccgccauccgggcggagcacacggggcgcgagaucguggaccugaugugccacgccaccuucaccaugcgccugcucagccccguccgggugccgaacuacaaccugaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcucucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccugaccgacggggaggagcgggucauccuggccggccccaugccggugacccacagcuccgccgcccagcgccgggggcgcaucggccggaaccccaagaacgagaacgaccaguacaucuacaugggggagccccucgagaacgacgaggacugcgcccacuggaaggaggcgaagaugcugcuggacaacaucaacacgcccgagggcaucaucccgagcauguucgagcccgagcgcgagaagguggacgccaucgacggcgaguaccggcuccgcggggaggcccgcaagaccuucgucgaccugaugcggcgcggcgaccugcccguguggcucgccuacaagguggccgcggaggggaucaacuacgccgaccggcgcuggugcuucgacggcaucaagaacaaccagauccuggaggagaacgucgagguggagaucuggaccaaggagggggagcggaagaagcugaagccgcgcuggcucgacgcccggaucuacuccgacccccuggcccugaaggaguucaaggaguucgccgcgggccgcaagagccucacccugaaccugaucacggagaugggccggcuccccaccuucaugacccagaagacccgcgacgcccuggacaaccuggccguccuccacacggccgaggccggcgggcgggccuacaaccacgcccuguccgagcugcccgagacccucgagacccugcugcuccugacccugcucgccacggugaccgggggcaucuuccuguuccugaugagcggccgcgggaucggcaagaugacccucgggaugugcugcaucaucaccgccuccacccugcugugguacgcgcagauccagccgcacuggaucgccgccagcaucauccucgaguucuuccugaucgugcugcucauccccgagcccgagaagcagcggacgccccaggacaaccagcugaccuacgucgugaucgccauccugaccguggucgccgcgaccauggccaacgagaugggcuuccucgagaagacgaagaaggaccuggggcugggcuccaucgccacccagcagccggagagcaacauccucgacaucgaccugcgccccgccuccgccuggacccuguacgcgguggccaccacguucgugacccccaugcuccggcacagcaucgagaacagcuccgucaacgugagccugaccgccaucgccaaccaggccaccgugcugaugggccucgggaagggcuggccccuguccaagauggacaucggggucccgcugcucgcgaucggcugcuacagccaggugaaccccaucacgcugaccgccgcccugcuccugcugguggcccacuacgcgaucaucgggcccggccuccaggccaaggccacccgcgaggcccagaagcgggccgcggccggcaucaugaagaaccccaccgucgacgggaucacggugaucgaccuggacccgauccccuacgaccccaaguucgagaagcagcugggccaggugaugcuccugauccugugcgucacccaggugcucaugaugcgcaccaccugggcccugugcgaggcccugacgcucgccaccgggcccaucuccacccugugggagggcaacccggggcgguucuggaacaccacgaucgcggugagcauggccaacaucuuccgcggcuccuaccuggccggcgccgggcuccuguucagcaucaugaagaacaccaccaacacccggcgcggcacggggaacaugggcgagacccugggcgagaaguggaagucccgccucaacgcccugggcaagagcgaguuccagaucuacaagaaguccgggauccaggaggucgaccggacccuggcgaaggaggggaucaagcgcggcgagaccgaccaccacgccgugagccggggguccgccaagcuccgcugguucguggagcggaacauggucacgcccgagggcaaggugguggaccugggcugcgggcgcggcggguggagcuacuacugcggcgggcugaagaacguccgggaggugaagggccucaccaagggcgggcccggccacgaggagcccaucccgauguccaccuacggguggaaccuggugcgccugcagagcggcgucgacguguucuucaucccgcccgagaagugcgacacccuccugugcgacaucggggaguccagccccaacccgacgguggaggccggccggacccugcgcguccucaaccugguggagaacuggcugaacaacaacacccaguucugcaucaaggugcugaaccccuacaugcccuccgucaucgagaagauggaggcgcuccagcggaaguacggcggggcccuggugcgcaacccgcugagccggaacagcacccacgagauguacuggguguccaacgccagcggcaacaucgucuccagcgugaacaugaucucccgcaugcucaucaaccgguucaccaugcgccacaagaaggccacguacgagcccgacguggaccuggggagcggcacccggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgcguccagcauggucaacggcguggugcggcuccugaccaagccgugggacguccugcccaccgugacgcagauggccaugaccgacaccacccccuucgggcagcagcgcguguucaaggagaaggucgacacgcgcacccaggagcccaaggagggcaccaagaagcucaugaagaucaccgccgaguggcuguggaaggagcugggcaagaagaagacgccgcggaugugcacccgcgaggaguucacccggaaggugcgcuccaacgccgcccucggggcgaucuucaccgacgagaacaaguggaaguccgcccgggaggccguggaggacucccgcuucugggagcuggucgacaaggagcggaaccugcaccucgagggcaagugcgagacgugcguguacaacaugauggggaagcgcgagaagaagcugggcgaguucgggaaggccaagggcagccgggccaucugguacauguggcugggcgcgcgcuuccucgaguucgaggcccugggguuccugaacgaggaccacugguucucccgggagaacagccucuccggcgucgagggggagggccugcacaagcugggguacauccuccgcgacgugagcaagaaggagggcggcgccauguacgccgacgacaccgcggggugggacacccggaucacccuggaggaccugaagaacgaggagauggugacgaaccacauggagggcgagcacaagaagcucgccgaggccaucuucaagcugaccuaccagaacaaggucgugcgcgugcagcggcccacgccccgcgggaccgucauggacaucaucagccggcgcgaccagcggggcuccggccagguggggaccuacggccugaacaccuucaccaacauggaggcccagcucauccgccagauggagggggagggcguguucaagaacauccagcaccugaccgucacggaggagguggccgugaagaacuggcuggcgcgggucgggcgcgagcgccucagccggauggccaucuccggcgacgacugcguggugaagccccuggacgaccgcuucgccaacgcccugaccgcccucaacgacaugggcaagauccggaaggacauccagcagugggagccgagcaagggguggaacgacuggacccagguccccuucugcucccaccacuuccacgagcugaucaugaaggacggccgcgugcuggugguccccugccggaaccaggacgagcucaucgggcgcgcgcggaucagccagggcgccggguggucccugcgcgagaccgccugccugggcaagagcuacgcccagauguggucccucauguacuuccaccggcgcgaccugcggcuggccgcgaacgccaucugcagcgccgugcccucccacugggugccgacgagccgcaccaccugguccauccacgccaagcacgaguggaugaccaccgaggacaugcucacggucuggaaccggguguggauccgcgagaaccccuggauggaggacaagacccccguggagagcugggaggagauccccuaccugggcaagcgggaggaccaguggugcgggucccugaucggccucaccagccgcgccaccugggcgaagaacauccaggccgccaucaaccagguccggucccugaucgggaacgaggaguacgccgacuacaugccgagcaugaagcgcuuccggcgcgaggaggaggaggcgggcgugcugugguga

SEQ ID NO: 9566 - RNA, 9876 nt, Artificial Sequence
  derived and/or modified CDS sequence (opt1) from DENV-2__EU482653__SS-prME
agcgcggggaugaucaucaugcugauccccaccgugauggccuuccaccucaccacccgcaacggggagccccacaugaucguggggauccaggagaaggggaagucccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacgcggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucgugaccgacaacguccacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgagucccacaaccagaccuuccugaucgacggccccgagacggcggagugcccgaacaccaaccgcgccuggaacagccuggaggucgaggacuacggguucggcguguucaccaccaacaucuggcuccggcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgucaucgugacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgucaccgccggccacggccagguggacaacuucagccugggcgugcugggcauggcccucuuccuggaggagaugcugcgcacccgggucgggacgaagcacgcgauccuccugguggccguguccuucgucacccugaucaccggcaacaugagcuucaaggaccucgggcgcgugguggucauggugggcgccaccauggccgacgacaucgggaugggcgugacguaccuggcccugcucgcggccuucaagguccggcccaccuucgccgccggccugcugcuccgcaagcugaccuccaaggagcugaugaugaccacgaucgggaucgugcuccugagccaguccaccauccccgagaccgugcuggagcucaccgacgcccuggcgcugggcaugaugguccucaagaucgugcgcaacauggagaaguaccagcuggccgucacgaucauggccauccugugcgugccgaacgccgugauccuccagaacgccuggaaggucagcugcaccauccuggcggugguguccgucagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggccaucauggcggugggcaugguguccauccuggccagcucccuccugaagaacgacauccccaugaccggcccccuggucgccgggggccuccugaccgugugcuacgugcugaccgggcggagcgccgaccucgagcuggagcgcgccacggacgucaagugggaggaccaggcggagaucuccggcagcagccccauccuguccaucaccaucagcgaggacggguccaugagcaucaagaacgaggaggaggagcagacccucaccauccugauccggacgggccugcucgugaucuccggccuguucccgaucagcauccccaucaccgccgccgccugguaccugugggaggugaagaagcagcgcgccgggguccucugggacgugcccagcccgccgcccaugggcaaggcggagcuggaggacggggccuaccggaucaagcagaagggcaucuucggguacagccagaucggcgccggcguguacaaggaggggaccuuccacaccauguggcacgucacccgcggcgccgugcugaugcacaaggggaagcggaucgagcccuccugggccgacgugaagaaggaccucaucagcuacggcgggggcuggaagcuggagggcgaguggaaggagggggaggagguccaggugcuggcgcucgagcccggcaagaacccccgcgccgugcagacgaagcccgggcuguucaagaccaacaccggcaccaucggggccgucucccuggacuucagccccggcacguccggcagccccaucaucgacaagaaggggaagguggugggccucuacgggaacggcgucgugacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccugcccgccaucguccgcgaggccaucaagcgggggcuccgcacccugauccuggcgccgacccgggugguggccgccgagauggaggaggcccuccgcggccugcccauccgguaccagacccccgccauccgcgcggagcacacggggcgcgagaucgucgaccugaugugccacgccaccuucaccaugcggcuccugagccccgugcgcgugccgaacuacaaccugaucaucauggacgaggcccacuucaccgaccccgccuccaucgccgcgcggggcuacaucagcacgcgcgucgagaugggcgaggccgccgggaucuucaugaccgccacgccgcccggcagccgggacccguucccccaguccaacgcccccaucaucgacgaggagcgcgagauccccgagcggagcuggaacuccgggcacgagugggugaccgacuucaagggcaagacggugugguucgucccgagcaucaaggcggggaacgacaucgccgccugccuccgcaagaacggcaagaaggugauccagcugucccggaagaccuucgacagcgaguacgugaagacccgcaccaacgacugggacuucgucgugacgaccgacaucuccgagaugggcgccaacuucaaggcggagcgggugaucgacccccgccggugcaugaagcccgucauccugaccgacggggaggagcgcgugauccucgccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcugcucgacaacaucaacacgcccgagggcaucaucccgagcauguucgagcccgagcgggagaaggucgacgccaucgacggcgaguaccgccugcgcggggaggcccggaagaccuucguggaccugaugcgccggggcgaccuccccguguggcuggccuacaaggucgccgcggaggggaucaacuacgccgaccgccgguggugcuucgacggcaucaagaacaaccagauccuggaggagaacguggaggucgagaucuggaccaaggagggggagcgcaagaagcucaagccgcgguggcuggacgcccgcaucuacuccgacccccuggcccucaaggaguucaaggaguucgccgcgggccggaagucccugacccugaaccucaucacggagaugggccgccugcccaccuucaugacccagaagacccgggacgcccuggacaaccucgccgugcugcacacggccgaggccggcgggcgcgccuacaaccacgcccuguccgagcuccccgagacccuggagacccugcuccugcugacccuccuggccacggugaccgggggcaucuuccuguuccucaugagcggccgggggaucggcaagaugacccuggggaugugcugcaucaucaccgccuccauccugcucugguacgcgcagauccagccgcacuggaucgccgccagcaucauccuggaguucuuccugaucguccuccugauccccgagcccgagaagcagcgcacgccccaggacaaccagcugacguacguggugaucgccauccucaccgucguggccgcgaccauggccaacgagaugggcuuccuggagaagaccaagaaggaccuggggcucggcuccaucgccacgcagcagccggagagcaacauccuggacaucgaccugcggcccgccuccgccuggacccucuacgcgguggccaccaccuucgucacgcccaugcugcgccacagcaucgagaacagcuccgugaacgugagccugaccgccaucgccaaccaggccaccguccucaugggccuggggaagggcuggccccuguccaagauggacaucggggugccgcuccuggcgaucggcugcuacagccaggugaaccccaucacccugacggccgcccuccugcugcucgucgcccacuacgcgaucaucgggcccggccugcaggccaaggccacccgggaggcccagaagcgcgccgcggccggcaucaugaagaaccccaccguggacgggaucaccgugaucgaccuggacccgauccccuacgaccccaaguucgagaagcagcucggccaggucaugcugcugauccucugcgugacccaggugcugaugaugcggaccaccugggcccugugcgaggcccucacccuggccacggggcccaucuccacccugugggagggcaacccggggcgcuucuggaacaccaccaucgcggucagcauggccaacaucuuccggggcuccuaccucgccggcgccgggcugcuguucagcaucaugaagaacacgaccaacgcccgccgcggcaccgggaacaugggcgagacccucggcgagaaguggaagucccggcugaacgcgcugggcaagagcgaguuccagaucuacaagaaguccggcauccaggagguggaccgcacgcucgccaaggaggggaucaagcggggcgagaccgaccaccacgccgugagccgcggguccgccaagcugcggugguucgucgagcgcaacauggugacccccgagggcaagguggucgaccugggcugcgggcggggcggguggagcuacuacugcggcgggcucaagaacgugcgcgaggugaagggccugaccaagggcgggcccggccacgaggagcccaucccgauguccacguacggguggaaccugguccggcuccagagcggcguggacguguucuucaucccgcccgagaagugcgacacccugcugugcgacaucggggaguccagccccaacccgaccgucgaggcgggccgcacccuccgggugcugaaccugguggagaacuggcucaacaacaacacgcaguucugcaucaagguccugaaccccuacaugcccuccgugaucgagaagauggaggcccugcagcgcaaguacggcggggcccuggugcggaacccgcucagccgcaacagcacccacgagauguacugggucuccaacgccagcggcaacaucguguccagcgugaacaugaucucccggaugcugaucaaccgcuucaccaugcggcacaagaaggccaccuacgagcccgacgucgaccuggggagcggcacccgcaacaucgggaucgaguccgagauccccaaccucgacaucaucggcaagcggaucgagaagaucaagcaggagcacgagacgagcuggcacuacgaccaggaccaccccuacaagaccugggcguaccacggcuccuacgagaccaagcagaccgggagcgccuccagcauggugaacggcgugguccgccugcugacgaagccgugggacgugcuccccaccgugacccagauggccaugaccgacacgacccccuucgggcagcagcgcgucuucaaggagaagguggacacccggacccaggagcccaaggagggcacgaagaagcugaugaagaucaccgccgaguggcuguggaaggagcucggcaagaagaagaccccgcgcaugugcacccgggaggaguucacgcgcaaggugcgguccaacgccgcgcugggggccaucuucaccgacgagaacaaguggaaguccgcccgcgaggccgucgaggacucccgguucugggagcugguggacaaggagcgcaaccuccaccuggagggcaagugcgagaccugcgucuacaacaugauggggaagcgggagaagaagcugggcgaguucgggaaggccaagggcagccgcgcgaucugguacauguggcucggcgcccgguuccuggaguucgaggcccugggguuccucaacgaggaccacugguucucccgcgagaacagccuguccggcguggagggggagggccugcacaagcucggguacauccugcgggacgugagcaagaaggagggcggcgccauguacgcggacgacaccgccgggugggacacgcgcaucacccuggaggaccucaagaacgaggagauggucaccaaccacauggagggcgagcacaagaagcuggccgaggccaucuucaagcugaccuaccagaacaagguggugcggguccagcgccccacgccccgggggaccgugauggacaucaucagccgccgggaccagcgcggcuccggccaggugggcaccuacggccucaacaccuucacgaacauggaggcccagcugauccggcagauggagggggagggcgucuucaagaacauccagcaccugaccgugaccgaggagguggcgguccagaacuggcucgcccgcguggggcgcgagcggcugagccgcauggccaucuccggcgacgacugcguggucaagccccuggacgaccgguucgccaacgcccucaccgcgcugaacgacaugggcaagauccgcaaggacauccagcagugggagccgagcaagggguggaacgacuggacgcagguccccuucugcucccaccacuuccacgagcugaucaugaaggacggccgggugcucgucgugcccugccgcaaccaggacgagcugaucgggcgggcccgcaucagccagggcgccggguggucccugcgggagaccgccugccucggcaagagcuacgcccagauguggucccugauguacuuccaccgccgggaccugcgccucgcggccaacgccaucugcagcgccgugcccucccacugggucccgaccagccggaccacgugguccauccacgccaagcacgaguggaugaccaccgaggacaugcugaccguguggaaccgcguguggauccgggagaaccccuggauggaggacaagacccccgucgagagcugggaggagauccccuaccugggcaagcgcgaggaccaguggugcgggucccucaucggccugacgagccgggcgaccugggccaagaacauccaggccgccaucaaccaggugcgcucccugaucgggaacgaggaguacaccgacuacaugccgagcaugaagcgguuccgccgcgaggaggaggaggcgggcgugcucugguga

SEQ ID NO: 9567 - RNA, 9876 nt, Artificial Sequence
  derived and/or modified CDS sequence (opt1) from DENV-2__EU482654__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagaugaccaucaugaccggggacaucaagggcaucaugcaggccgggaagcgcagccuccggccgcagcccacggagcugaaguacuccuggaagaccuggggcaaggccaagaugcugagcaccgaguccuacaaccagaccuuccucaucgacggccccgagacggcggagugcccgaacaccaaccgcgccuggaacagccuggagguggaggacuacggguucggcgucuucaccaccaacaucuggcugaagcucaaggagaagcaggacgccuucugcgacuccaagcugaugagcgccgccaucaaggacaaccgggcggugcacgccgacaugggguacuggaucgaguccgcccugaacgacacguggaagaucgagaaggccagcuucaucgaggugaagaacugccacuggcccaagucccacacccucuggagcaacggcguccuggaguccgagaugaucauccccaagaaccuggccggccccgugagccagcacaacuaccgcccgggguaccacacccagaucgcgggccccuggcaccucgggaagcuggagauggacuucgacuucugcgacggcaccaccgugaucgucacggaggacugcgggaaccggggccccucccugcgcaccaccaccgccagcggcaagcucaucacggaguggugcugccggagcugcacccugcccccgcugcgcuaccgcggggaggacggcugcugguacgggauggagauccgcccccucaaggagaaggaggagaaccuggugaacucccuggugaccgccggccacgggcaggucgacaacuucagccucggcgugcugggcauggcccuguuccucgaggagaugcugcggacccgcguggggacgaagcacgcgauccugcucgucgccguguccuucgugacccugaucaccggcaacaugagcuucaaggaccuggggcgggucguggugauggucggcgccaccauggccgacgacaucgggaugggcgugacguaccucgcccugcuggcggccuucaaggugcgccccaccuucgccgccggccuccugcugcggaagcucaccuccaaggagcugaugaugaccacgaucgggaucguccugcucagccaguccaccauccccgagaccgugcuggagcugaccgacgcccucgcgcugggcaugauggugcugaagaucguccgcaacauggagaaguaccagcucgccgugacgaucauggccauccugugcgucccgaacgccgugauccugcagaacgccuggaaggugagcugcaccauccucgcggucguguccgugagcccccugcugcucaccuccagccagcagaagaccgacuggaucccccuggcccugacgaucaaggggcucaaccccaccgccaucuuccugaccacccugucccgcacgaacaagaagcggagcuggccgcucaacgaggccaucauggcggucggcaugguguccauccuggccagcucccugcucaagaacgacauccccaugaccggcccccugguggccgggggccugcucaccgucugcuacgugcugaccgggcgcagcgccgaccuggagcucgagcgggccacggacgugaagugggaggaccaggcggagaucuccggcagcagccccauccuguccaucaccaucagcgaggacggguccaugagcaucaagaacgaggaggaggagcagacccugaccauccucauccgcacgggccugcuggucaucuccggccucuucccgaucagcauccccaucaccgccgccgccugguaccugugggaggugaagaagcagcgggccggggugcugugggacguccccagcccgccgcccaugggcaaggcggagcucgaggacggggccuaccgcaucaagcagaagggcauccugggguacagccagaucggcgccggcguguacaaggaggggaccuuccacaccauguggcacgugacccggggcgccguccugaugcacaaggggaagcgcaucgagcccuccugggccgacgugaagaaggaccucaucagcuacggcgggggcuggaagcuggagggcgaguggaaggagggggaggaggugcagguccuggcgcucgagcccggcaagaacccccgggccgugcagacgaagcccgggcuguucaagaccaacaccggcaccaucggggccgugucccuggacuucagccccggcacguccggcagccccaucaucgacaagaaggggaaggucgugggccucuacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccugcccgccaucgugcgggaggccaucaagcgcgggcuccggacccugauccuggcgccgacccgcgucguggccgccgagauggaggaggcccuccggggccugcccauccgcuaccagacccccgccauccgggcggagcacacggggcgcgagaucguggaccugaugugccacgccaccuucaccaugcgccuccugagccccguccgggugccgaacuacaaccugaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccuccggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccugaccgacggggaggagcgggucauccucgccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcugcucgacaacaucaacacgcccgagggcaucaucccgagcauguucgagcccgagcgcgagaagguggacgccaucgacggcgaguaccggcugcgcggggaggcccgcaagaccuucgucgaccugaugcggcgcggcgaccuccccguguggcuggccuacaagguggccgcggaggggaucaacuacgccgaccggcgcuggugcuucgacggcaucaagaacaaccagauccuggaggagaacgucgagguggagaucuggaccaaggagggggagcggaagaagcucaagccgcgcuggcuggacgcccggaucuacuccgacccccuggcccucaaggaguucaaggaguucgccgcgggccgcaagagccugacccugaaccucaucacggagaugggccggcugcccaccuucaugacccagaagacccgcgacgcccuggacaaccucgccguccugcacacggccgaggccggcgggcgggccuacaaccacgcccuguccgagcuccccgagacccuggagacccugcuccugcugacccuccuggccacggugaccgggggcaucuuccuguuccucaugagcggccgcgggaucggcaagaugacccuggggaugugcugcaucaucaccgccuccauccugcucugguacgcgcagauccagccgcacuggaucgccgccagcaucauccuggaguucuuccugaucgugcuccugauccccgagcccgagaagcagcggacgccccaggacaaccagcugacguacgucgugaucgccauccucaccguggucgccgcgaccauggccaacgagaugggcuuccuggagaagaccaagaaggaccuggggcucggcuccaucgccacgcagcagccggagagcaacauccuggacaucgaccugcgccccgccuccgccuggacccucuacgcgguggccaccaccuucgugacgcccaugcugcggcacagcaucgagaacagcuccgucaacgugagccugaccgccaucgccaaccaggccaccgugcucaugggccuggggaagggcuggccccuguccaagauggacaucggggucccgcuccuggcgaucggcugcuacagccaggugaaccccaucacccugacggccgcccuccugcugcucguggcccacuacgcgaucaucgggcccggccugcaggccaaggccacccgcgaggcccagaagcgggccgcggccggcaucaugaagaaccccaccgucgacgggaucaccgugaucgaccuggacccgauccccuacgaccccaaguucgagaagcagcucggccaggugaugcugcugauccucugcgucacccaggugcugaugaugcgcaccaccugggcccugugcgaggcccucacccuggccacggggcccaucuccacccugugggagggcaacccggggcgguucuggaacaccaccaucgcggugagcauggccaacaucuuccgcggcuccuaccucgccggcgccgggcugcuguucagcaucaugaagaacacgaccaacacccggcgcggcaccgggaacaugggcgagacgcucggcgagaaguggaagucccgccugaacacccuggggaaguccgaguuccagaucuacaagaaguccggcauccaggaggucgaccggacccucgccaaggaggggaucaagcgcggcgagaccgaccaccacgcggugagccggggguccgccaagcugcgcugguucguggagcggaacauggucacgcccgagggcaaggugguggaccugggcugcgggcgcggcggguggagcuacuacugcggcgggcucaagaacguccgggaggugaagggccugaccaagggcgggcccggccacgaggagcccaucccgauguccaccuacggguggaaccuggugcgccuccagagcggcgucgacguguucuucaucccgcccgagaagugcgacacccugcugugcgacaucggggaguccagccccaacccgacgguggaggccggccggacccuccgcguccugaaccugguggagaacuggcucaacaacaacacccaguucugcaucaaggugcugaaccccuacaugcccuccgucaucgagaagauggaggcccugcagcggaaguacggcggggcgcuggugcgcaacccgcucagccggaacagcacccacgagauguacuggguguccaacgccagcggcaacaucgucuccagcgugaacaugaucucccgcaugcugaucaaccgguucaccaugcgccacaagaaggccacguacgagcccgacguggaccuggggagcggcacccggaacaucgggaucgaguccgagacccccaaccucgacaucaucggcaagcgcaucgagaagaucaagcaggagcacgagaccagcuggcacuacgaccaggaccaccccuacaagacgugggccuaccacggcuccuacgagaccaagcagaccgggagcgccuccagcauggucaacggcguggugcggcugcugaccaagccgugggacguccuccccacggugacccagauggcgaugaccgacaccacgcccuucgggcagcagcgcguguucaaggagaaggucgacacccgcacccaggagcccaaggagggcaccaagaagcugaugaagaucacggccgaguggcuguggaaggagcucggcaagaagaagaccccgcggaugugcacccgcgaggaguucacccggaaggugcgcuccaacgccgcccugggggccaucuucacggacgagaacaaguggaaguccgcgcgggaggccguggaggacucccgcuucugggagcuggucgacaaggagcggaaccuccaccuggagggcaagugcgagaccugcguguacaacaugauggggaagcgcgagaagaagcugggcgaguucgggaaggccaagggcagccgggccaucugguacauguggcucggcgcccgcuuccuggaguucgaggcgcugggguuccucaacgaggaccacugguucucccgggagaacagccuguccggcgucgagggggagggccugcacaagcucggguacauccugcgcgacgugagcaagaaggagggcggcgccauguacgccgacgacaccgccgggugggacacccggaucacgcuggaggaccucaagaacgaggagauggugaccaaccacauggagggcgagcacaagaagcuggcggaggccaucuucaagcugaccuaccagaacaaggucgugcgcgugcagcggcccacgccccgggggacggucauggacaucaucagccggcgcgaccagcggggcuccggccagguggggaccuacggccucaacaccuucaccaacauggaggcccagcugauccgccagauggagggggagggcguguucaagaacauccagcaccugacggucaccgaggagguggccgugcagaacuggcucgcccgggucgggcgcgagcgccugagccggauggcgaucuccggcgacgacugcguggugaagccccuggacgaccgcuucgccaacgcccucaccgcccugaacgacaugggcaagauccggaaggacauccagcagugggagccgagcaagggguggaacgacuggacccagguccccuucugcucccaccacuuccacgagcugaucaugaaggacggccgcgugcucgugguccccugccggaaccaggacgagcugaucgggcgcgcccggaucagccagggcgcgggguggucccugcgcgagacggccugccucggcaagagcuacgcccagauguggucccugauguacuuccaccggcgcgaccugcggcucgccgccaacgcgaucugcagcgccgugcccucccacugggugccgaccagccgcaccaccugguccauccacgccaagcacgaguggaugaccacggaggacaugcugaccgucuggaaccggguguggauccgcgagaaccccuggauggaggacaagacccccguggagagcugggaggagauccccuaccugggcaagcgggaggaccaguggugcgggucccucaucggccugaccagccgcgccacgugggccaagaacauccaggcggccaucaaccagguccggucccugaucgggaacgaggaguacaccgacuacaugccgagcaugaagcgcuuccggcgcgaggaggaggaggccggcgugcucugguga

SEQ ID NO: 9568 - RNA, 9876 nt, Artificial Sequence
  derived and/or modified CDS sequence (opt1) from DENV-2__EU482656__SS-prME
agcgcggggaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucgugaccgacaacguccacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgagucccacaaccagaccuuccugaucgacggccccgagacggcggagugcccgaacaccaaccgcgccuggaacagccuggaggucgaggacuacggguucggcguguucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgucaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgucaccgccggccacggccagguggacaacuucagccugggcgugcugggcauggcccucuuccuggaggagaugcugcggacccgcgucgggacgaagcacgcgauccuccugguggccguguccuucgucacccugaucaccggcaacaugagcuucaaggaccucgggcgggugguggucauggugggcgccaccauggccgacgacaucgggaugggcgugacguaccuggcccugcucgcggccuucaagguccgccccaccuucgccgccggccugcugcuccggaagcugaccuccaaggagcugaugaugaccacgaucgggaucgugcuccugagccaguccaccauccccgagaccgugcuggagcucaccgacgcccuggcgcugggcaugaugguccucaagaucgugcgcaacauggagaaguaccagcuggccgucacgaucauggccauccugugcgugccgaacgccgugauccuccagaacgccuggaaggucagcugcaccauccuggcggugguguccgucagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcaugguguccauccuggccagcucccuccugaagaacgacauccccaugaccggcccccuggucgccgggggccuccugaccgugugcuacgugcugaccgggcgcagcgccgaccucgagcuggagcgggccacggacgucaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggugaagaagcagcgggccgggguccucugggacgugcccagcccgccgcccaugggcaaggcggagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcgcuggagcccggcaagaacccccgggccgugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucguccgggaggccaucaagcgcgggcugcggacccugauccucgcgccgacccgcgugguggccgccgagauggaggaggcccugcggggccugcccauccgcuaccagacccccgccauccgggcggagcacacggggcgcgagaucgucgaccucaugugccacgccaccuucaccaugcgccugcugagccccgugcgggugccgaacuacaaccucaucaucauggacgaggcccacuucaccgaccccgccuccaucgccgcgcgcggcuacaucagcacgcgggucgagaugggcgaggccgccgggaucuucaugaccgccacgccgcccggcagccgcgacccguucccccaguccaacgcccccauccuggacgaggagcgggagauccccgagcgcagcuggaacuccgggcacgagugggugaccgacuucgagggcaagacggugugguucgucccgagcaucaaggcggggaacgacaucgccgccugccugcggaagaacggcaagaaggugauccagcucucccgcaagaccuucgacagcgaguacgugaagacccggaccaacgacugggacuucgucgugacgaccgacaucuccgagaugggcgccaacuucaaggcggagcgcgugaucgacccccggcgcugcaugaagcccgucauccugaccgacggggaggagcgggugauccuggccggccccaugccggugacccacagcuccgccgcccagcgccgggggcgcaucggccggaaccccaagaacgagaacgaccaguacaucuacaugggggagccccucgagaacgacgaggacugcgcccacuggaaggaggcgaagaugcugcuggacaacaucaacacgcccgagggcaucaucccgagcauguucgagcccgagcgcgagaaggucgacgccaucgacggcgaguaccggcuccgcggggaggcccgcaagaccuucguggaccugaugcggcgcggcgaccugcccguguggcucgccuacaaggucgccgcggaggggaucaacuacgccgaccggcgcuggugcuucgacggcaucaagaacaaccagauccuggaggagaacguggaggucgagaucuggaccaaggagggggagcggaagaagcugaagccgcgcuggcucgacgcccggaucuacuccgacccccuggcccugaaggaguucaaggaguucgccgcgggccgcaagagccucacccugaaccugaucacggagaugggccggcuccccaccuucaugacccagaagacccgcgacgcccuggacaaccuggccgugcuccacacggccgaggccggcgggcgggccuacaaccacgcccuguccgagcugcccgagacccucgagacccugcugcuccugacccugcucgccacggugaccgggggcaucuuccuguuccugaugagcggccgcgggaucggcaagaugacccucgggaugugcugcaucaucaccgccuccauccugcugugguacgcgcagauccagccgcacuggaucgccgccagcaucauccucgaguucuuccugaucguccugcucauccccgagcccgagaagcagcggacgccccaggacaaccagcugacguacguggugaucgccauccugaccgucguggccgcgaccauggccaacgagaugggcuuccucgagaagaccaagaaggaccuggggcugggcuccguggccacgcagcagccggagagcaacauccucgacaucgaccugcgccccgccuccgccuggacccuguacgcggucgccaccaccuucgugacgcccaugcuccggcacagcaucgagaacagcuccgugaacgucagccugaccgccaucgccaaccaggccaccgugcugaugggccucgggaagggcuggccccuguccaagauggacaucggggugccgcugcucgcgaucggcugcuacagccaggucaaccccaucacccugacggccgcccugcuccugcugguggcccacuacgcgaucaucgggcccggccuccaggccaaggccacccgcgaggcccagaagcgggccgcggccggcaucaugaagaaccccaccguggacgggaucaccgucaucgaccuggacccgauccccuacgaccccaaguucgagaagcagcugggccaggugaugcuccugauccugugcgugacgcagguccucaugaugcgcaccaccugggcccugugcgaggcccugacccucgccacggggcccaucuccacccugugggagggcaacccggggcgguucuggaacaccaccaucgcggugagcauggccaacaucuuccgcggcuccuaccuggccggcgccgggcuccuguucagcaucaugaagaacacgaccaacacccggcgcggcaccgggaacaugggcgagacgcugggcgagaaguggaagucccgccucaacgcccuggggaaguccgaguuccagaucuacaagaaguccggcauccaggagguggaccggacccuggcgaaggaggggaucaagcgcggcgagaccgaccaccacgccgucagccggggguccgccaagcuccgcugguucguggagcggaacauggugacccccgagggcaaggucguggaccugggcugcgggcgcggcggguggagcuacuacugcggcgggcugaagaacgugcgggaggucaagggccucacgaagggcgggcccggccacgaggagcccaucccgauguccaccuacggguggaaccuggugcgccugcagagcggcguggacgucuucuucaucccgcccgagaagugcgacacccuccugugcgacaucggggaguccagccccaacccgaccguggaggccggccggacgcugcgcgugcucaaccuggucgagaacuggcugaacaacaacacccaguucugcaucaaggugcugaaccccuacaugcccuccgugaucgagaagauggaggcgcuccagcggaaguacggcggggcccugguccgcaacccgcugagccggaacagcacccacgagauguacuggguguccaacgccagcggcaacaucguguccagcgucaacaugaucucccgcaugcucaucaaccgguucaccaugcgccacaagaaggccaccuacgagcccgacguggaccuggggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggugaacggcgucgugcggcuccugaccaagccgugggacgugcugcccaccgucacccagauggccaugacggacaccacccccuucgggcagcagcgcguguucaaggagaagguggacacccgcacgcaggagcccaaggagggcaccaagaagcucaugaagaucaccgccgaguggcuguggaaggagcugggcaagaagaagaccccgcggaugugcacgcgcgaggaguucacccggaagguccgcuccaacgccgcccucggggcgaucuucaccgacgagaacaaguggaaguccgcccgggaggccguggaggacucccgcuucugggagcuggucgacaaggagcggaaccugcaccucgagggcaagugcgagaccugcguguacaacaugauggggaagcgcgagaagaagcugggcgaguucgggaaggccaagggcagccgggccaucugguacauguggcugggcgcgcgcuuccucgaguucgaggcccugggguuccugaacgaggaccacugguucucccgggagaacagccucuccggcguggagggggagggccugcacaagcugggguacauccuccgcgacgucagcaagaaggagggcggcgccauguacgccgacgacacggcggggugggacacccggaucacccuggaggaccugaagaacgaggagauggugaccaaccacauggagggcgagcacaagaagcucgccgaggccaucuucaagcugacguaccagaacaaggugguccgcgugcagcggcccacgccccgggggaccgugauggacaucaucagccggcgcgaccagcggggcuccgggcaggucggcaccuacggccugaacacguucaccaacauggaggcccagcucauccgccagauggagggggagggcguguucaagaacauccagcaccugaccgugaccgaggaggucgccgugcagaacuggcuggcgcggguggggcgcgagcgccucagccggauggccaucuccggcgacgacugcgucgugaagccccuggacgaccgcuucgccaacgcccugacggcccucaacgacaugggcaagauccggaaggacauccagcagugggagccgagcaagggguggaacgacuggacccaggugcccuucugcucccaccacuuccacgagcugaucaugaaggacggccgcguccugguggugcccugccggaaccaggacgagcucaucgggcgcgcgcggaucagccagggcgccggguggucccugcgcgagaccgccugccugggcaagagcuacgcccagauguggucccucauguacuuccaccggcgcgaccugcggcuggccgcgaacgccaucugcagcgccguccccucccacugggugccgaccagccgcacgaccugguccauccacgccaagcacgaguggaugaccaccgaggacaugcucaccguguggaaccgggucuggauccgcgagaaccccuggauggaggacaagacgcccguggagagcugggaggagauccccuaccugggcaagcgggaggaccaguggugcgggucccugaucggccucaccagccgcgccaccugggcgaagaacauccaggccgccaucaaccaggugcggucccugaucgggaacgaggaguacaccgacuacaugccgagcaugaagcgcuuccggcgcgaggaggaggaggccggcguccugugguga

SEQ ID NO: 9569 - RNA, 9876 nt, Artificial Sequence
  derived and/or modified CDS sequence (opt1) from DENV-2__EU482657__SS-prME
agcgcggggaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggaucaugcggcacccgggcuucacgaucauggccgcgauccuggccuacaccaucgggaccacccacuuccagcgcguccugaucuucauccuccugacggccguggcccccuccaugaccaugcggugcaucggcaucagcaaccgcgacuucguggagggcgucuccgggggcagcuggguggacaucgugcuggagcacggguccugcgucaccaccauggcgaagaacaagcccacgcucgacuucgagcugaucaagaccgaggccaagcagcccgccacccugcggaaguacugcaucgaggccaagcucaccaacacgaccaccgagagccgcugccccacccagggcgagcccucccugaaggaggagcaggacaagcgguucgugugcaagcacagcaugguggaccgcggcugggggaacggcugcgggcuguucggcaagggcgggaucgucacgugcgccauguucacgugcaagaagaacauggagggcaagaucgugcagcccgagaaccucgaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccuggacuucaacgagauggugcuccugcagauggagaacaaggccuggcuggugcaccgccagugguuccucgaccugccccugcccuggcucccgggggccgacaagcaggaguccaacuggauccagaaggagacccuggucaccuucaagaacccccacgccaagaagcaggacguggucgugcugggcagccaggagggggcgaugcacacggcccucaccggcgccaccgagauccagaugagcuccgggaaccugcuguucaccggccaccucaagugccggcugcgcauggacaagcugcagcucaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccugggccggcucaucaccgugaacccgaucgugacggagaaggacucccccgucaacaucgaggccgagccgcccuucggggacagcuacaucaucaucggcguggagccggggcagcugaagcugaacugguucaagaagggcuccagcaucgggcagauguucgagaccaccaugcgcggcgcgaagcgcauggccauccucggcgacaccgccugggacuucgggucccugggcgggguguucacgagcaucggcaaggcccugcaccaggucuucggggccaucuacggcgcggccuucuccggcgugagcuggaccaugaagauccucaucggggugaucaucaccuggaucggcaugaacucccggagcaccucccugagcgucucccuggugcugguggggaucgucacgcucuaccugggcgugauggugcaggccgacagcgggugcgucguguccuggaagaacaaggagcugaagugcggcagcggcaucuucaucaccgacaacgugcacaccuggaccgagcaguacaaguuccagcccgagagccccuccaagcucgccagcgcgauccagaaggcccaggaggaggggaucugcggcauccgcuccgucacgcggcuggagaaccugauguggaagcagaucacccccgagcucaaccacauccuggccgagaacgaggugaagcugaccaucaugaccggggacauccgcggcaucaugcaggccgggaagcggagccuccgcccgcagcccacggagcugaaguacuccuggaagaccuggggcaaggccaagaugcugagcaccgaguccuacaaccagaccuuccucaucgacggccccgagacggcggagugcccgaacaccaaccgggccuggaacagccuggagguggaggacuacggguucggcgucuucaccaccaacaucuggcugaagcucaaggagaagcaggacgccuucugcgacuccaagcugaugagcgccgccaucaaggacaaccgcgcggugcacgccgacaugggguacuggauggaguccgcccugaacgacacguggaagaucgagaaggccagcuucaucgaggugaagaacugccacuggcccaagucccacacccucuggagcaacggcguccuggaguccgagaugaucauccccaagaaccuggccggccccgugagccagcacaacuaccggccgggguaccacacccagaucgcgggccccuggcaccucgggaagcuggagauggacuucgacuucugcgacggcaccaccgugaucgucacggaggacugcgggaaccgcggccccucccugcggaccaccaccgccagcggcaagcucaucacggaguggugcugccgcagcugcacccugcccccgcugcgguaccgcggggaggacggcugcugguacgggauggagauccggccccucaaggagaaggaggagaaccuggugaacucccuggugaccgccggccacgggcaggucgacaacuucagccucggcgugcugggcauggcccuguuccucgaggagaugcugcgcacccggguggggacgaagcacgcgauccugcucgucgccguguccuucgugacccugaucaccggcaacaugagcuucaaggaccuggggcgcgucguggugauggucggcgccaccauggccgacgacaucgggaugggcgugacguaccucgcccugcuggcggccuucaaggugcggcccaccuucgccgccggccuccugcugcgcaagcucaccuccaaggagcugaugaugaccacgaucgggaucguccugcucagccaguccaccauccccgagaccgugcuggagcugaccgacgcccucgcgcugggcaugauggugcugaagaucguccgcaacauggagaaguaccagcucgccgugacgaucauggccauccugugcgucccgaacgccgugauccugcagaacgccuggaaggugagcugcaccauccucgcggucguguccgugagcccccugcugcucaccuccagccagcagaagaccgacuggaucccccuggcccugacgaucaaggggcucaaccccaccgccaucuuccugaccacccugucccggacgaacaagaagcgcagcuggccgcucaacgaggccaucauggcggucggcaugguguccauccuggccagcucccugcucaagaacgacauccccaugaccggcccccugguggccgggggccugcucaccgucugcuacgugcugaccgggcggagcgccgaccuggagcucgagcgcgccacggacgugaagugggaggaccaggcggagaucuccggcagcagccccauccuguccaucaccaucagcgaggacggguccaugagcaucaagaacgaggaggaggagcagacccugaccauccucauccggacgggccugcuggucaucuccggccucuucccgaucagcauccccaucaccgccgccgccugguaccugugggaggugaagaagcagcgcgccggggugcugugggacguccccagcccgccgcccaugggcaaggcggagcucgaggacggggccuaccggaucaagcagaagggcauccugggguacagccagaucggcgccggcguguacaaggaggggaccuuccacaccauguggcacgugacccgcggcgccguccugaugcacaaggggaagcggaucgagcccuccugggccgacgugaagaaggaccucaucagcuacggcgggggcuggaagcuggagggcgaguggaaggagggggaggaggugcagguccuggcgcucgagcccggcaagaacccccgcgccgugcagacgaagcccgggcuguucaagaccaacaccggcaccaucggggccgugucccuggacuucagccccggcacguccggcagccccaucaucgacaagaaggggaaggucgugggccucuacgggaacggcguggucacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccugcccgccaucgugcgcgaggccaucaagcgggggcuccgcacccugauccuggcgccgacccgggucguggccgccgagauggaggaggcccuccgcggccugcccauccgguaccagacccccgccauccgcgcggagcacacggggcgcgagaucguggaccugaugugccacgccaccuucaccaugcggcuccugagccccguccgcgugccgaacuacaaccugaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagacggugugguucgugccgagcaucaaggcggggaacgacaucgccgccugccuccgcaagaacggcaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccugaccgacggggaggagcgcgucauccucgccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcugcucgacaacaucaacacgcccgagggcaucaucccgagcauguucgagcccgagcgggagaagguggacgccaucgacggcgaguaccgccugcgcggggaggcccggaagaccuucgucgaccugaugcgccggggcgaccuccccguguggcuggccuacaagguggccgcggaggggaucaacuacgccgaccgccgguggugcuucgacggcaucaagaacaaccagauccuggaggagaacgucgagguggagaucuggaccaaggagggggagcgcaagaagcucaagccgcgguggcuggacgcccgcaucuacuccgacccccuggcccucaaggaguucaaggaguucgccgcgggccggaagucccugacccugaaccucaucacggagaugggccgccugcccaccuucaugacccagaagacccgggacgcccuggacaaccucgccguccugcacacggccgaggccggcgggcgcgccuacaaccacgcccuguccgagcuccccgagacccuggagacccugcuccugcugacccuccuggccacggugaccgggggcaucuuccuguuccucaugagcggccgggggaucggcaagaugacccuggggaugugcugcaucaucaccgccuccacccugcucugguacgcgcagauccagccgcacuggaucgccgccagcaucauccuggaguucuuccugaucgugcuccugauccccgagcccgagaagcagcgcacgccccaggacaaccagcugaccuacgucgugaucgccauccucaccguggucgccgcgaccauggccaacgagaugggcuuccuggagaagacgaagaaggaccuggggcucggcuccaucgccacccagcagccggagagcaacauccuggacaucgaccugcggcccgccuccgccuggacccucuacgcgguggccaccacguucgugacccccaugcugcgccacagcaucgagaacagcuccgucaacgugagccugaccgccaucgccaaccaggccaccgugcucaugggccuggggaagggcuggccccuguccaagauggacaucggggucccgcuccuggcgaucggcugcuacagccaggugaaccccaucacgcugaccgccgcccuccugcugcucguggcccacuacgcgaucaucgggcccggccugcaggccaaggccacccgggaggcccagaagcgcgccgcggccggcaucaugaagaaccccaccgucgacgggaucacggugaucgaccuggacccgauccccuacgaccccaaguucgagaagcagcucggccaggugaugcugcugauccucugcgucacccaggugcugaugaugcggaccaccugggcccugugcgaggcccucacgcuggccaccgggcccaucuccacccugugggagggcaacccggggcgcuucuggaacaccacgaucgcggugagcauggccaacaucuuccggggcuccuaccucgccggcgccgggcugcuguucagcaucaugaagaacaccaccaacacccgccgcggcacggggaacaucggcgagacccucggcgagaaguggaagucccggcugaacgcccugggcaagagcgaguuccagaucuacaagaaguccggcauccaggaggucgaccgcacccucgcgaaggaggggaucaagcggggcgagaccgaccaccacgccgugagccgcggguccgccaagcugcggugguucguggagcgcaacauggucacgcccgagggcaaggugguggaccugggcugcgggcggggcggguggagcuacuacugcggcgggcucaagaacguccgcgaggugaagggccugaccaagggcgggcccggccacgaggagcccaucccgauguccaccuacggguggaaccuggugcggcuccagagcggcgucgacguguucuucaucccgcccgagaagugcgacacccugcugugcgacaucggggaguccagccccaacccgacgguggaggccggccgcacccuccggguccugaaccugguggagaacuggcucaacaacaacacccaguucugcaucaaggugcugaaccccuacaugcccuccgucaucgagaagauggaggcgcugcagcgcaaguacggcggggcccuggugcggaacccgcucagccgcaacagcacccacgagauguacuggguguccaacgccagcggcaacaucgucuccagcgugaacaugaucucccggaugcugaucaaccgcuucaccaugcggcacaagaaggccacguacgagcccgacguggaccuggggagcggcacccgcaacaucgggaucgaguccgagauccccaaccucgacaucaucggcaagcggaucgagaagaucaagcaggagcacgaggccagcuggcacuacgaccaggaccaccccuacaagaccugggcguaccacggcuccuacgagaccaagcagacggggagcgccuccagcauggucaacggcguggugcgccugcugaccaagccgugggacguccuccccaccgugacccagauggccaugacggacaccacccccuucgggcagcagcgcguguucaaggagaaggucgacacccggacgcaggagcccaaggagggcaccaagaagcugaugaagaucaccgccgaguggcuguggaaggagcucggcaagaagaagaccccgcgcaugugcacgcgggaggaguucacccgcaaggugcgguccaacgccgcgcugggggccaucuucaccgacgagaacaaguggaaguccgcccgcgaggccguggaggacucccgguucugggagcuggucgacaaggagcgcaaccuccaccuggagggcaagugcgagaccugcguguacaacaugauggggaagcgggagaagaagcugggcgaguucgggaaggccaagggcagccgcgcgaucugguacauguggcucggcgcccgguuccuggaguucgaggcccugggguuccucaacgaggaccacugguucucccgcgagaacagccuguccggcgucgagggggagggccugcacaagcucggguacauccugcgggacgugagcaagaaggagggcggcgccauguacgcggacgacacggccgggugggacacccgcaucacccuggaggaccucaagaacgaggagauggugaccaaccacauggagggcgagcacaagaagcuggccgaggccaucuucaagcugacguaccagaacaaggucgugcgggugcagcgccccacgccccgggggaccgucauggacaucaucagccgccgggaccagcgcggcuccggccaggugggcaccuacggccucaacacguucaccaacauggaggcccagcugauccggcagauggagggggagggcguguucaagaacauccagcaccugaccgucaccgaggagguggcggugcacaacuggcucgcccgcgucgggcgcgagcggcugagccgcauggccaucuccggcgacgacugcguggugaagccccuggacgaccgguucgccaacgcccucacggcgcugaacgacaugggcaagauccgcaaggacauccagcagugggagccgagcaagggguggaacgacuggacccagguccccuucugcucccaccacuuccacgagcugaucaugaaggacggccgggugcucgugguccccugccgcaaccaggacgagcugaucgggcgggcccgcaucagccagggcgccggguggucccugcgggagaccgccugccucggcaagagcuacgcccagauguggucccugauguacuuccaccgccgggaccugcgccucgcggccaacgccaucugcagcgccgugcccucccacugggugccgaccagccggacgaccugguccauccacgccaagcacgaguggaugaccaccgaggacaugcugaccgucuggaaccgcguguggauccgggagaaccccuggauggaggacaagacgcccguggagagcugggaggagauccccuaccugggcaagcgcgaggaccaguggugcgggucccucaucggccugaccagccgggcgaccugggccaagaacauccaggccgccaucaaccagguccgcucccugaucgggaacgaggaguacaccgacuacaugccgagcaugaagcgguuccgccgcgaggaggaggaggcgggcgugcucugguga

SEQ ID NO: 9570 - RNA, 9876 nt, Artificial Sequence
  derived and/or modified CDS sequence (opt1) from DENV-2__EU482658__SS-prME
agcgcggggaugaucaucaugcugauccccaccgugauggccuuccaccucaccacccgcaacggggagccccacaugaucgugggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacgugaucguccucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggugaaggagaucgccgagacccagcacggcaccaucgucauccgggugcaguacgagggggacggcagccccugcaagauccccuucgagaucauggaccuggagaagcgcuacgugcucggccggcugaucaccgucaacccgaucgugacggagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccagguguucggggccaucuacggcgcggccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacgaccgagugcccgaacaccaaccgcgcguggaacagccuggagguggaggacuacggguucggcguguucaccacgaacaucuggcucaagcugaaggagaagcaggacgccuucugcgacuccaagcugaugagcgccgccaucaaggacaaccgggccguccacgcggacaugggguacuggaucgaguccgcccucaacgacaccuggaagaucgagaaggccagcuucaucgaggugaagaacugccacuggcccaagucccacacccuguggagcaacggcgugcuggaguccgagaugaucauccccaagaaccucgccggccccgucagccagcacaacuaccgcccgggguaccacacccagaucgccggccccuggcaccuggggaagcuggagauggacuucgacuucugcgacggcaccacggugaucgugaccgaggacugcgggaaccggggccccucccuccgcaccaccacggcgagcggcaagcugaucaccgaguggugcugccggagcugcacccugcccccgcuccgcuaccgcggggaggacggcugcugguacgggauggagauccgcccccugaaggagaaggaggagaaccuggucaacucccucgugaccgccggccacggccagguggacaacuucagccugggcguccugggcauggcccucuuccuggaggagaugcugcggacgcgcguggggaccaagcacgccauccuccuggugaccgucuccuucgugacccugaucacgggcaacaugagcuucaaggaccucgggcggguggucgugauggugggcgcgaccauggccgacgacaucgggaugggcgucaccuaccuggcccugcucgccgccuucaaggugcgccccaccuucgcggccggccugcugcuccggaagcugacguccaaggagcugaugaugaccaccaucgggaucgugcuccugagccaguccaccauccccgagacgguccuggagcucaccgacgcccuggcccugggcaugauggugcucaagaucgugcgcaacauggagaaguaccagcuggccgucaccaucauggcgauccugugcgugccgaacgccgucauccuccagaacgccuggaaggugagcugcaccauccuggccguggucuccgugagcccccugcuccugacguccagccagcagaagaccgacuggaucccccuggcccucaccaucaaggggcugaaccccaccgcgaucuuccugacgacccucucccgcaccaacaagaagcggagcuggccgcugaacgaggccaucauggccgugggcauggucuccauccuggccagcucccuccugaagaacgacauccccaugaccggcccccugguggccggcgggcuccugacggugugcuacguccugaccgggcgcagcgccgaccucgagcuggagcgggccaccgacgugaagugggaggaccaggccgagaucuccgggagcagccccauccuguccaucaccaucagcgaggacggguccaugagcaucaagaacgaggaggaggagcagacgcucaccauccugauccgcaccggccugcucgugaucuccggccuguucccgaucagcauccccaucaccgccgcggccugguaccugugggaggucaagaagcagcgggccggggugcucugggacgugcccagcccgccgcccaugggcaaggccgagcuggaggacggggccuaccgcaucaagcagaagggcauccugggguacagccagaucggcgcgggcgucuacaaggaggggaccuuccacacgauguggcacgugacccggggcgccgugcucaugcacaaggggaagcgcaucgagcccuccugggccgacgucaagaaggaccugaucagcuacggcgggggcuggaagcuggagggcgaguggaaggagggggaggagguccaggugcucgcccuggagcccggcaagaacccccgggccguccagaccaagcccgggcuguucaagaccaacacgggcaccaucggggcggugucccucgacuucagccccggcaccuccggcagccccaucaucgacaagaaggggaagguggucggccuguacgggaacggcguggugacccgcuccggcgccuacgucagcgccaucgcccagacggagaaguccaucgaggacaaccccgagaucgaggacgacaucuuccggaagcgccggcugaccaucauggaccugcaccccggggccggcaagaccaagcgcuaccuccccgcgaucgugcgggaggccaucaagcgcgggcugcggacccugauccucgccccgacgcgcguggucgccgcggagauggaggaggcccugcggggccugcccauccgcuaccagacccccgccauccgggccgagcacaccgggcgcgagaucguggaccucaugugccacgccaccuucacgaugcgccugcugagccccgugcgggucccgaacuacaaccucaucaucauggacgaggcgcacuucaccgaccccgccuccaucgccgcccgcggcuacaucagcacccggguggagaugggcgaggccgcggggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagaccgucugguucgugccgagcaucaaggccgggaacgacaucgccgcgugccugcggaagaacggcaagaaggugauccagcugucccgcaagaccuucgacagcgaguacgucaagacgcggaccaacgacugggacuucguggugaccaccgacaucuccgagaugggcgccaacuucaaggccgagcgcgucaucgacccccggcgcugcaugaagcccgugauccucacggacggggaggagcgggugauccuggccggccccaugccggucacccacagcuccgcggcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgccaucgacggcgaguaccggcugcgcggggaggcgcgcaagaccuucguggaccucaugcggcgcggcgaccugcccgucuggcuggccuacaagguggccgccgaggggaucaacuacgccgaccggcgcuggugcuucgacggcaucaagaacaaccagauccucgaggagaacguggaggucgagaucuggacgaaggagggggagcggaagaagcugaagccgcgcuggcuggacgcgcggaucuacuccgacccccucgcccugaaggaguucaaggaguucgccgccggccgcaagagccugacccucaaccugaucaccgagaugggccggcugcccaccuucaugacgcagaagacccgcgacgcccucgacaaccuggcggugcugcacaccgccgaggccgggggccgggccuacaaccacgcgcucuccgagcugcccgagacccuggagacgcuccugcugcucacccugcuggccaccgucaccgggggcaucuuccucuuccugaugagcggccgcgggaucggcaagaugacccuggggaugugcugcaucaucacggccuccauccuccugugguacgcccagauccagccgcacuggaucgccgcgagcaucauccuggaguucuuccucaucgugcugcugauccccgagcccgagaagcagcggacgccccaggacaaccagcucaccuacguggucaucgccauccugaccgugguggccgccacgauggccaacgagaugggcuuccuggagaagaccaagaaggaccucgggcugggcuccaucgcgacccagcagccggagagcaacauccuggacaucgaccuccgccccgccuccgccuggacccuguacgccgucgccacgaccuucgugacccccaugcugcggcacagcaucgagaacagcuccgugaacgucagccucaccgcgaucgccaaccaggccacggugcugaugggccuggggaagggcuggccccucuccaagauggacaucggggugccgcugcuggccaucggcugcuacagccaggucaaccccaucacccucaccgccgcgcugcugcuccugguggcccacuacgccaucaucgggcccggccugcaggccaaggcgacccgcgaggcccagaagcgggccgccgccggcaucaugaagaaccccacgguggacgggaucaccgucaucgaccucgacccgauccccuacgaccccaaguucgagaagcagcugggccaggugaugcugcucauccugugcgugacccagguccugaugaugcgcaccacgugggcgcucugcgaggcccugacccuggccaccgggcccaucuccacccucugggagggcaacccggggcgguucuggaacacgaccaucgccgugagcauggccaacaucuuccgcggcuccuaccuggcgggcgccgggcuccucuucagcaucaugaagaacaccaccaacacgcggcgcggcaccgggaacaucggcgagacccugggcgagaaguggaagucccgccugaacgcccucgggaaguccgaguuccagaucuacaagaaguccggcauccaggagguggaccggacccuggccaaggaggggaucaagcgcggcgagacggaccaccacgccgucagccggggguccgcgaagcugcgcugguucguggagcggaacauggugacccccgagggcaaggucguggaccucggcugcgggcgcggcggguggagcuacuacugcggcgggcugaagaacgugcgggaggucaagggccugaccaagggcgggcccggccacgaggagcccaucccgauguccaccuacggguggaaccucgugcgccugcagagcggcguggacgucuucuucaucccgcccgagaagugcgacacgcugcucugcgacaucggggaguccagccccaacccgaccguggaggccggccggacccugcgcgugcugaaccucgucgagaacuggcugaacaacaacacccaguucugcaucaaggugcugaaccccuacaugcccuccgugaucgagaagauggaggcccugcagcggaaguacggcggggcccucguccgcaacccgcugagccggaacagcacccacgagauguacuggguguccaacgcgagcggcaacaucguguccagcgucaacaugaucucccgcaugcugaucaaccgguucacgaugcgccacaagaaggccaccuacgagcccgacguggaccucgggagcggcacccggaacaucgggaucgaguccgagauccccaaccuggacaucaucggcaagcgcaucgagaagaucaagcaggagcacgagaccagcuggcacuacgaccaggaccaccccuacaagacgugggccuaccacggcuccuacgagaccaagcagaccgggagcgccuccagcauggugaacggcgucgugcggcugcucaccaagccgugggacgugcugcccacggucacccagauggccaugaccgacaccacgcccuucgggcagcagcgcguguucaaggagaagguggacacccgcacccaggagcccaaggagggcaccaagaagcugaugaagaucacggcggaguggcucuggaaggagcugggcaagaagaagaccccgcggaugugcacccgcgaggaguucacccggaagguccgcuccaacgccgcccugggggccaucuucacggacgagaacaaguggaaguccgcccgggaggcgguggaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcccgcuuccuggaguucgaggcccucggguuccugaacgaggaccacugguucucccgggagaacagccuguccggcguggagggggagggccuccacaagcugggguacauccugcgcgacgucagcaagaaggagggcggcgcgauguacgccgacgacaccgccgggugggacacccggaucacgcucgaggaccugaagaacgaggagauggugaccaaccacauggagggcgagcacaagaagcuggccgaggcgaucuucaagcucaccuaccagaacaaggugguccgcgugcagcggcccacgccccgggggacggugauggacaucaucagccggcgcgaccagcggggcuccgggcaggucggcaccuacggccugaacaccuucaccaacauggaggcccagcugauccgccagauggagggggagggcguguucaagaacauccagcaccucacggugaccgaggaggucgccgugcagaacuggcuggcccggguggggcgcgagcgccugagccggauggccaucuccggcgacgacugcgucgugaagccccucgacgaccgcuucgcgaacgcccugaccgcccugaacgacaugggcaagauccggaaggacauccagcagugggagccgagcaagggguggaacgacuggacccaggugcccuucugcucccaccacuuccacgagcucaucaugaaggacggccgcguccugguggugcccugccggaaccaggacgagcugaucgggcgcgcccggaucagccagggcgccggguggucccuccgcgagacggcgugccugggcaagagcuacgcccagauguggucccugauguacuuccaccggcgcgaccuccggcuggccgccaacgccaucugcagcgcgguccccucccacugggugccgaccagccgcaccaccugguccauccacgccaagcacgaguggaugaccacggaggacaugcugaccguguggaaccgggucuggauccgcgacaaccccuggauggaggacaagacccccguggagagcugggaggagauccccuaccucggcaagcgggaggaccaguggugcgggucccugaucggccugaccagccgcgccacgugggccaagaacauccaggccgcgaucaaccaggugcggucccucaucgggaacgaggaguacaccgacuacaugccgagcaugaagcgcuuccggcgcgaggaggaggaggccggcguccugugguga

SEQ ID NO: 9571 - RNA, 9876 nt, Artificial Sequence
  derived and/or modified CDS sequence (opt1) from DENV-2__EU482659__SS-prME
agcgccgggaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacgaccgagugcccgaacaccaaccgcgcguggaacagccuggagguggaggacuacggguucggcgucuucaccacgaacaucuggcucaagcugaaggagaagcaggacgccuucugcgacuccaagcugaugagcgccgccaucaaggacaaccgggccgugcacgcggacaugggguacuggaucgaguccgcccucaacgacaccuggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgccggccccuggcaccuggggaagcuggagauggacuucgacuucugcgacggcaccacggugaucgucaccgaggacugcgggaaccggggccccucccuccgcaccaccacggcgagcggcaagcugaucaccgaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacgcgcguggggaccaagcacgccauccuccuggucgcgguguccuucgugacccugaucaccggcaacaugagcuucaaggaccucgggcgggucguggugauggucggcgccacgauggccgacgacaucgggaugggcgugaccuaccuggcccugcucgccgcguucaaggugcgccccaccuucgccgccggccugcugcuccggaagcugaccuccaaggagcugaugaugacgaccaucgggaucguccuccugagccaguccaccauccccgagaccgugcuggagcucacggacgcccuggcccugggcaugauggugcucaagaucguccgcaacauggagaaguaccagcuggcggugaccaucauggccauccugugcgucccgaacgccgugauccuccagaacgccuggaaggugagcugcaccauccuggccgucguguccgugagcccccugcuccugaccuccagccagcagaagacggacuggaucccccuggcgcucaccaucaaggggcugaaccccaccgccaucuuccugaccacgcucucccgcaccaacaagaagcggagcuggccgcugaacgaggccaucauggccgucggcaugguguccauccuggcgagcucccuccugaagaacgacauccccaugaccggcccccugguggccgggggccuccugaccgucugcuacgugcugacggggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacccucacgauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguacaaggaggggaccuuccacaccauguggcacgugacgcggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgcuccggcgccuacgugagcgccaucgcccagaccgagaaguccaucgaggacaaccccgagaucgaggacgacaucuuccggaagcgccggcugacgaucauggaccugcaccccggggcgggcaagaccaagcgcuaccuccccgccaucgugcgggaggccaucaagcgcgggcugcggacccugauccucgccccgacccgcgucguggcggccgagauggaggaggcccugcggggccugcccauccgcuaccagacgcccgccauccgggccgagcacaccgggcgcgagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggcgaggcggccgggaucuucaugaccgccacgccgcccggcagccgcgacccguucccccaguccaacgcccccaucaucgacgaggagcgggagauccccgagcgcagcuggaacacggggcacgagugggucaccgacuucaagggcaagaccgugugguucgugccguccaucaaggccgggaacgacaucgcggccugccugcggaagaacggcaagaaggucauccagcugagccgcaagaccuucgacuccgaguacgugaagacgcggaccaacgacugggacuucguggucaccaccgacaucagcgagaugggcgccaacuucaaggccgagcgcgugaucgacccccggcgcugcaugaagcccgugauccucacggacggggaggagcgggucauccuggcgggccccaugccggugacccacuccagcgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccguccauguucgagcccgagcgcgagaagguggacgcgaucgacggcgaguaccggcugcgcggggaggcccgcaagaccuucgucgaccucaugcggcgcggcgaccugcccguguggcuggccuacaagguggccgccgaggggaucaacuacgcggaccggcgcuggugcuucgacggcaucaagaacaaccagauccucgaggagaacgucgagguggagaucuggacgaaggagggggagcggaagaagcugaagccgcgcuggcuggacgcccggaucuacagcgacccccucgcccugaaggaguucaaggaguucgccgccggccgcaagucccugacccucaaccugaucaccgagaugggccggcugcccaccuucaugacgcagaagacccgcgacgcgcucgacaaccuggccguccugcacaccgccgaggccgggggccgggcguacaaccacgcccucagcgagcugcccgagacccuggagacgcuccugcugcucacccugcuggccaccgugaccgggggcaucuuccucuuccugauguccggccgcgggaucggcaagaugacccuggggaugugcugcaucaucacggccagcauccuccugugguacgcccagauccagccgcacuggaucgcggccuccaucauccuggaguucuuccucaucgugcugcugauccccgagcccgagaagcagcggacgccccaggacaaccagcucaccuacgucgugaucgccauccugaccguggucgccgccacgauggcgaacgagaugggcuuccuggagaagaccaagaaggaccucgggcugggcagcaucgccacccagcagccggaguccaacauccuggacaucgaccuccgccccgccagcgccuggacccuguacgccguggcgacgaccuucgugacccccaugcugcggcacuccaucgagaacagcagcgucaacgugucccucaccgccaucgccaaccaggccacggugcugaugggccuggggaagggcuggccccucagcaagauggacaucggggucccgcugcuggccaucggcugcuacucccaggugaaccccaucacccucaccgcggcccugcugcuccugguggcccacuacgccaucaucgggcccggccugcaggcgaaggccacccgcgaggcccagaagcgggccgccgcgggcaucaugaagaaccccacggucgacgggaucaccgugaucgaccucgacccgauccccuacgaccccaaguucgagaagcagcugggccaggugaugcugcucauccugugcgucacccaggugcugaugaugcgcaccacgugggcccucugcgaggcccugacccuggccaccgggcccaucagcacccucugggagggcaacccggggcgguucuggaacacgaccaucgccguguccauggcgaacaucuuccgcggcagcuaccuggccggcgccgggcuccucuucuccaucaugaagaacaccaccaacacgcggcgcggcaccgggaacaucggcgagacccugggcgagaaguggaagucccgccugaacgcccucgggaaguccgaguuccagaucuacaagaaguccggcauccaggaggucgaccggacccuggccaaggaggggaucaagcgcggcgagacggaccaccacgcggugucccgggggagcgccaagcugcgcugguucguggagcggaacauggucacccccgagggcaaggugguggaccucggcugcgggcgcggcgggugguccuacuacugcggcgggcugaagaacguccgggaggugaagggccugaccaagggcgggcccggccacgaggagcccaucccgaugagcaccuacggguggaaccucgugcgccugcaguccggcgucgacguguucuucaucccgcccgagaagugcgacacgcugcucugcgacaucggggagagcucccccaacccgaccguggaggccggccggacccugcgcguccugaaccucguggagaacuggcugaacaacaacacccaguucugcaucaaggugcugaaccccuacaugcccagcgucaucgagaagauggaggcccugcagcggaagcacggcggggcgcucgugcgcaacccgcugucccggaacagcacccacgagauguacugggugagcaacgccuccggcaacaucgucagcuccgugaacaugaucagccgcaugcugaucaaccgguucacgaugcgccacaagaaggccaccuacgagcccgacguggaccucggguccggcacccggaacaucgggaucgagagcgagauccccaaccuggacaucaucggcaagcgcaucgagaagaucaagcaggagcacgagaccuccuggcacuacgaccaggaccaccccuacaagacgugggccuaccacggcagcuacgagaccaagcagaccggguccgccagcuccauggucaacggcguggugcggcugcucaccaagccgugggacguccugcccacggugacccagauggcgaugaccgacaccacgcccuucgggcagcagcgcguguucaaggagaaggucgacacccgcacccaggagcccaaggagggcaccaagaagcugaugaagaucacggccgaguggcucuggaaggagcugggcaagaagaagaccccgcggaugugcacccgcgaggaguucacccggaaggugcgcagcaacgccgcccugggggccaucuucacggacgagaacaaguggaaguccgcgcgggaggccguggaggacagccgcuucugggagcucgucgacaaggagcggaaccugcaccuggagggcaagugcgagaccugcguguacaacaugauggggaagcgcgagaagaagcucggcgaguucgggaaggccaagggcucccgggccaucugguacauguggcugggcgcccgcuuccuggaguucgaggcgcucggguuccugaacgaggaccacugguucagccgggagaacucccugagcggcgucgagggggagggccuccacaagcugggguacauccugcgcgacguguccaagaaggagggcggcgccauguacgccgacgacaccgccgggugggacacccggaucacgcucgaggaccugaagaacgaggagauggugaccaaccacauggagggcgagcacaagaagcuggcggaggccaucuucaagcucaccuaccagaacaaggucgugcgcgugcagcggcccacgccccgggggacggucauggacaucaucagccggcgcgaccagcggggcagcggccagguggggaccuacggccugaacaccuucaccaacauggaggcccagcugauccgccagauggagggggagggcguguucaagaacauccagcaccucacggucaccgaggagguggccgugcagaacuggcuggcccgggucgggcgcgagcgccugucccggauggcgaucagcggcgacgacugcguggugaagccccucgacgaccgcuucgccaacgcccugaccgcccugaacgacaugggcaagauccggaaggacauccagcagugggagccguccaagggguggaacgacuggacccagguccccuucugcagccaccacuuccacgagcucaucaugaaggacggccgcgugcuggugguccccugccggaaccaggacgagcugaucgggcgcgcccggaucucccagggcgcgggguggagccuccgcgagacggccugccugggcaaguccuacgcccagauguggagccugauguacuuccaccggcgcgaccuccggcuggccgccaacgcgaucugcuccgccgugcccagccacugggugccgaccucccgcaccaccuggagcauccacgccaagcacgaguggaugaccacggaggacaugcugaccgucuggaaccggguguggauccgcgagaaccccuggauggaggacaagacccccguggaguccugggaggagauccccuaccucggcaagcgggaggaccaguggugcgggagccugaucggccugaccucccgcgccacgugggccaagaacauccaggcggccaucaaccagguccggagccucaucggggacgaggaguacaccgacuacaugccguccaugaagcgcuuccggcgcgaggaggaggaggccggcgugcugugguga

SEQ ID NO: 9572 - RNA, 9876 nt, Artificial Sequence
  derived and/or modified CDS sequence (opt1) from DENV-2__EU482661__SS-prME
agcgccgggaugaucaucaugcugauccccaccgugauggccuuccaccucaccacccgcaacggggagccccacaugaucgucgggauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacgugggcaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgagggggacaucuuccggaagcgccggcugaccaucauggaccugcaccccggcgccgggaagacgaagcgcuaccuccccgccaucgugcgggaggccaucaagcgcggccugcggacccugauccucgcgccgacccgcgucguggccgccgagauggaggaggcccugcgggggcugcccauccgcuaccagacccccgccauccgggcggagcacacgggccgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggggaggccgccggcaucuucaugaccgccacgccgcccgggagccgcgacccguucccccaguccaacgcccccaucaucgacgaggagcgggagauccccgagcgcagcuggaacuccggccacgagugggucaccgacuucaaggggaagacggugugguucgugccgagcaucaaggcgggcaacgacaucgccgccugccugcggaagaacggcaagaaggucauccagcugucccgcaagaccuucgacagcgaguacgugaagacccggaccaacgacugggacuucguggucacgaccgacaucuccgagaugggggccaacuucaaggcggagcgcgugaucgacccccggcgcugcaugaagcccgugauccucaccgacggcgaggagcgggucauccuggccgggcccaugccggugacccacagcuccgccgcccagcgccggggccgcaucgggcggaaccccaagaacgagaacgaccaguacaucuacaugggcgagccccuggagaacgacgaggacugcgcccacuggaaggaggcgaagaugcuccuggacaacaucaacacgcccgagggcaucaucccgagcauguucgagcccgagcgcgagaagguggacgccaucgacggggaguaccggcugcgcggcgaggcccgcaagaccuucgucgaccucaugcggcgcggggaccugcccguguggcuggccuacaagguggccgcggagggcaucaacuacgccgaccggcgcuggugcuucgacgggaucaagaacaaccagauccucgaggagaacgucgagguggagaucuggaccaaggagggcgagcggaagaagcugaagccgcgcuggcuggacgcccggaucuacuccgacccccucgcccugaaggaguucaaggaguucgccgcgggccgcaagagccugacccucaaccugaucacggagauggggcggcugcccaccuucaugacccagaagacccgcgacgcccucgacaaccuggccguccugcacacggccgaggcgggcgggcgggccuacaaccacgcccucuccgagcugcccgagacccuggagacccuccugcugcucacccugcuggccacggugaccggcggcaucuuccucuuccugaugagcgggcgcggcaucgggaagaugacccugggcaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggguuccuggagaagaccaagaaggaccucggccugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugauggggcugggcaagggguggccccucuccaagauggacaucggcgucccgcugcuggcgaucgggugcuacagccaggugaaccccaucacccucacggccgcccugcugcuccugguggcccacuacgcgaucaucggccccggccugcaggccaaggccacccgcgaggcccagaagcgggccgcggccgggaucaugaagaaccccaccgucgacggcaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacgggccccaucuccacccucugggaggggaacccgggccgguucuggaacaccaccaucgcggugagcauggccaacaucuuccgcggcuccuaccuggccggggccggccuccucuucagcaucaugaagaacacgaccaacacccggcgcgggaccggcaacaucggcgagacgcugggggagaaguggaagucccgccugaacgcccucggcaagagcgaguuccagaucuacaagaaguccgggauccaggaggucgaccggacccuggcgaaggagggcaucaagcgcggggagaccgaccaccacgccgugagccggggcuccgccaagcugcgcugguucguggagcggaacauggucacccccgagggcaaggugguggaccucgggugcggccgcgggggcuggagcuacuacugcgggggccugaagaacguccgggaggugaagggccugacgaagggcgggcccgggcacgaggagcccaucccgauguccaccuacggcuggaaccucgugcgccugcagagcggggucgacguguucuucaucccgcccgagaagugcgacacccugcucugcgacaucggcgaguccagccccaacccgaccguggaggccggccggacgcugcgcguccugaaccucguggagaacuggcugaacaacaacacccaguucugcaucaaggugcugaaccccuacaugcccuccgucaucgagaagauggaggcgcugcagcggaaguacgggggcgcccucgugcgcaacccgcugagccggaacagcacccacgagauguacuggguguccaacgccagcgggaacaucgucuccagcgugaacaugaucucccgcaugcugaucaaccgguucaccaugcgccacaagaaggccaccuacgagcccgacguggaccucggcagcgggacgcggaacaucggcaucgaguccgagauccccaaccuggacaucaucggcaagcgcaucgagaagaucaagcaggagcacgagaccagcuggcacuacgaccaggaccaccccuacaagaccugggccuaccacggguccuacgagaccaagcagacgggcagcgcguccagcauggucaacgggguggugcggcugcucaccaagccgugggacguccugcccaccgugacccagauggccaugacggacaccacccccuucggccagcagcgcguguucaaggagaaggucgacacccgcacgcaggagcccaaggagggcaccaagaagcugaugaagaucaccgccgaguggcucuggaaggagcuggggaagaagaagaccccgcggaugugcacgcgcgaggaguucacccggaaggugcgcuccaacgccgcccugggcgcgaucuucaccgacgagaacaaguggaaguccgcccgggaggccguggaggacucccgcuucugggagcucgucgacaaggagcggaaccugcaccuggaggggaagugcgagaccugcguguacaacaugaugggcaagcgcgagaagaagcucggggaguucggcaaggccaagggcagccgggccaucugguacauguggcugggggcgcgcuuccuggaguucgaggcccucggcuuccugaacgaggaccacugguucucccgggagaacagccuguccggggucgagggcgaggggcuccacaagcugggcuacauccugcgcgacgugagcaagaaggagggcggggccauguacgccgacgacacggcgggcugggacacccggaucacccucgaggaccugaagaacgaggagauggugaccaaccacauggagggggagcacaagaagcuggccgaggccaucuucaagcucacguaccagaacaaggucgugcgcgugcagcggcccacgccccggggcaccgucauggacaucaucagccggcgcgaccagcggggguccggccaggugggcaccuacgggcugaacacguucaccaacauggaggcccagcugauccgccagauggagggcgaggggguguucaagaacauccagcaccucaccgucaccgaggagguggccgugcagaacuggcuggcgcgggucggccgcgagcgccugagccggauggccaucuccggcgacgacugcguggugaagccccucgacgaccgcuucgccaacgcccugacggcccugaacgacauggggaagauccggaaggacauccagcagugggagccgagcaagggcuggaacgacuggacccagguccccuucugcucccaccacuuccacgagcucaucaugaaggacgggcgcgugcuggugguccccugccggaaccaggacgagcugaucggccgcgcgcggaucagccagggggccggcuggucccuccgcgagaccgccugccugggcaagagcuacgcccagauguggucccugauguacuuccaccggcgcgaccuccggcuggccgcgaacgccaucugcagcgccgugcccucccacugggugccgaccagccgcacgaccugguccauccacgccaagcacgaguggaugaccaccgaggacaugcugaccgucuggaaccggguguggauccgcgagaaccccuggauggaggacaagacgcccguggagagcugggaggagauccccuaccucgggaagcgggaggaccaguggugcggcucccugaucgggcugaccagccgcgccaccugggcgaagaacauccaggccgccaucaaccagguccggucccucaucggcaacgaggaguacaccgacuacaugccgagcaugaagcgcuuccggcgcgaggaggaggaggccggggugcugugguga

SEQ ID NO: 9573 - RNA, 9876 nt, Artificial Sequence
  derived and/or modified CDS sequence (opt1) from DENV-2__EU482662__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacacgaucaccuacaagugcccccuccugcggcagaacgagcccgaggacaucgacugcuggugcaacuccaccagcaccugggugacguacgggaccugcaccaccacgggcgagcaccggcgcgagaagcgguccgucgcccuggugccccacguggggaugggccucgagacccggaccgagaccuggaugagcuccgagggggccuggaagcacgcccagcggaucgagacguggauccugcgccaccccggcuucaccaucauggcggccauccuggccuacaccaucgggaccacgcacuuccagaaggcccucaucuucauccugcugaccgcggucgcccccagcaugaccaugcggugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccggaaguacugcaucgaggcgaagcugacgaacaccaccaccgagucccgcugcccgacgcagggcgagcccagccugaacgaggagcaggacaagcgguucgucugcaagcacuccaugguggaccgcggcugggggaacggcugcgggcuguucggcaagggcgggaucgugaccugcgccauguucacgugcaagaagaacauggagggcaagaucguccagcccgagaaccuggaguacaccaucgugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccggaccggccucgacuucaacgagauggugcugcugcagauggaggacaaggccuggcucgugcaccgccagugguuccuggaccugccccuccccuggcugccgggggcggacacccagggcagcaacuggauccagaaggagacgcuggucaccuucaagaacccccacgccaagaagcaggacguggugguccucgggucccaggagggcgccaugcacaccgcccugaccggggccacggagauccagaugagcagcggcaaccuccuguucaccggccaccugaagugccggcugcgcauggacaagcuccagcugaaggggauguccuacagcaugugcaccggcaaguucaagaucgugaaggagaucgcggagacccagcacgggacgaucgucauccgggugcaguacgagggcgacggcucccccugcaagauccccuucgagaucauggaccuggagaagcgccacgugcucgggcggcugaucaccgucaacccgaucgugaccgagaaggacagccccgugaacaucgaggccgagccgcccuucggcgacuccuacaucaucaucggggucgagccgggccagcugaagcucaacugguucaagaaggggagcuccaucggccagauguucgagaccacgaugcgcggcgccaagcgcauggccauccugggggacaccgccugggacuucggcagccucggcgggguguucaccuccaucgggaaggcgcuccaccagguguucggggccaucuacggcgccgccuucagcggggucuccuggaccaugaagauccugaucggcgcgaucaucacguggaucgggaugaacagccgguccaccagccuguccgugagccuggugcucgucggcgugaucacccuguaccugggggccauggugcaggccgacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcgcacgaggagggcaucugcgggauccgcagcgucacccggcuggagaaccucauguggaagcagaucacccccgagcugaaccacauccuguccgagaacgaggugaagcucacgaucaugaccggcgacaucaaggggaucaugcaggccggcaagcgcagccugcggccgcagcccaccgagcugaaguacuccuggaagaccuggggcaaggccaagaugcucagcacggagucccacaaccagaccuuccugaucgacgggcccgagaccgccgagugcccgaacaccaaccgcgccuggaacagccuggagguggaggacuacggcuucggggucuucacgaccaacaucuggcucaagcugcgggagaagcaggacguguucugcgacuccaagcugaugagcgcggccaucaaggacaaccgcgccgugcacgccgacaugggcuacuggaucgaguccgcccucaacgacaccuggaagauggagaaggcgagcuucaucgaggucaaguccugccacuggcccaagagccacacccugugguccaacggcgugcuggagagcgagaugaucauccccaaguccuucgccgggcccgugagccagcacaacuaccggccgggcuacuacacccagacggccgggcccuggcaccucggcaagcuggagauggacuucgacuucugcgaggggaccaccgucguggugaccgaggacugcggcaaccgcggccccagccugcggacgaccaccgccuccgggaagcucaucaccgaguggugcugccgcagcugcacgcugcccccgcugcgguaccgcggcgaggacgggugcugguacggcauggagauccggccccucaaggagaaggaggagaaccuggucaacucccuggugaccgcggggcacggccagaucgacaacuucagccucggcgugcuggggauggcccuguuccucgaggagaugcugcgcacccgggucggcaccaagcacgccauccugcucguggccguguccuucaugacgcugaucaccgggaacaugagcuuccgcgaccugggccgggucauggugauggugggggccaccaugaccgacgacaucggcaugggcgucacguaccucgcgcugcuggccgccuucaaggugcgccccaccuucgccgccgggcuccugcugcgcaagcucaccuccaaggagcugaugauggcgaccaucggcaucgcccugcucagccaguccacgauccccgagaccauccuggagcugaccgacgcccucgcccuggggaugauggugcugaagaucguccggaacauggagaaguaccagcucgccgugaccaucauggcgaucagcugcgugccgaacgccgucauccugcagaacgccuggaagguguccugcacgauccuggccgcggugagcgucagcccccuccugcugaccagcucccagcagaaggccgacuggaucccccucgcccugaccaucaagggccugaaccccaccgccaucuuccucacgacccugagccgcaccuccaagaagcggagcuggccgcugaacgaggccaucauggcggugggcaugguguccauccucgccagcagccugcugaagaacgacauccccaugaccgggccccucgucgccggcgggcugcugacggugugcuacguccucaccggccgcuccgccgaccuggagcuggagcgggccaccgacgugaagugggaggaccaggcggagaucagcggguccagccccauccucuccaucaccaucagcgaggacggcuccaugagcaucaagaacgaggaggaggagcagacgcugaccauccugauccgcaccggccuccuggugaucuccgggcuguucccggucagcauccccaucaccgccgccgccugguaccucugggaggugaagaagcagcgggccggcgugcugugggacguccccagcccgccgcccguggggaaggcggagcuggaggacggcgccuaccgcaucaagcagaaggggauccucggcuacagccagaucggcgccgggguguacaaggagggcaccuuccacacgauguggcacgucacccgcggggccgugcugaugcaccgcggcaagcggaucgagcccuccugggccgacgugaagaaggaccugaucagcuacgggggcggcuggaagcucgagggggaguggaaggagggcgaggagguccaggugcuggcgcuggagcccgggaagaacccccgcgccgugcagaccaagcccggccucuucaagaccaacacggggaccaucggcgccgucucccuggacuucagccccggcaccuccgggagccccaucguggaccggaagggcaagguggucgggcuguacggcaacggcguggugacccgcuccggggccuacgucagcgcgaucgcccagacggagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacccucauccuggcgccgacgcggguggucgccgccgagauggaggaggcccugcgcgggcuccccauccgcuaccagacccccgccauccgggcggagcacaccggccgcgagaucguggaccugaugugccacgccaccuucacgaugcggcugcucucccccgugcgcgucccgaacuacaaccugaucaucauggacgaggcccacuucaccgaccccgccagcaucgccgcgcggggcuacaucuccacccgcguggagaugggggaggccgccggcaucuucaugaccgccacgccgcccgggagccgggacccguucccccaguccaacgcgcccaucaucgacgaggagcgcgagauccccgagcggagcuggaacuccggccacgagugggugaccgacuucaaggggaagaccgucugguucgugccgagcaucaaggccggcaacgacaucgccgccugccugcgcaagaacggcaagaaggugauccagcucucccggaagaccuucgacagcgaguacgucaagacgcgcaccaacgacugggacuucguggugaccaccgacaucuccgagaugggggccaacuucaaggcggagcgggucaucgacccccgccggugcaugaagcccgugauccugacggacggcgaggagcgcgugauccuggccgggcccaugccggucacccacagcuccgccgcccagcggcgcggccggaucgggcgcaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgcgagaagguggacgccaucgacggggaguaccggcuccgcggcgaggcccggaagaccuucguggaccugaugcgccgcggggaccugcccgucuggcucgccuaccgcguggccgcggagggcaucaacuacgccgaccggcgcuggugcuucgacggggugaagaacaaccagauccuggaggagaacgucgagguggagaucuggacgaaggagggcgagcggaagaagcugaagccgcgcuggcucgacgcccggaucuacuccgacccccuggcccugaaggaguucaaggaguucgcggccggccgcaagagccucacccugaaccugaucaccgagauggggcggcuccccaccuucaugacgcagaaggcccgcgacgcccuggacaaccuggccgugcuccacaccgcggaggccggcgggcgggccuacaaccacgcccuguccgagcugcccgagacccucgagacccugcugcuccugacgcugcucgccaccgucaccggcggcaucuuccuguuccugaugagcgggaagggcguggggaagaugacccucggcaugugcugcaucaucaccgcguccauccugcugugguacgcccagauccagccgcacuggaucgccgccagcaucauccucgaguucuuccugaucgugcugcucauccccgagcccgagaagcagcgcacgccccaggacaaccagcugaccuacgucgugaucgccauccugaccgucguggcggccaccauggccaacgagaugggguuccucgagaagacgaagaaggaccugggccugggcagcaucgccacccaggagccggaguccaacauccucgacaucgaccugcggcccgccagcgcguggacccuguacgccguggccaccacguucgucacccccaugcuccgccacuccaucgagaacagcuccgugaacgugagccugaccgccaucgcgaaccaggccaccguccugauggggcucggcaagggguggccccuguccaagauggacaucggcgugccgcugcucgccaucgggugcuacagccaggugaaccccaucacgcugaccgccgcccugcuccugcugaucgcgcacuacgccaucaucggccccggccuccaggccaaggccacccgggaggcccagaagcgcgcggccgccgggaucaugaagaaccccaccgucgacggcaucacggugaucgaccuggacccgauccccuacgaccccaaguucgagaagcagcugggccaggugaugcuccugauccugugcgucacccaggugcucaugaugcggaccaccugggcccugugcgaggcccugacgcucgcgaccggccccaucuccacccugugggaggggaacccgggccgcuucuggaacaccacgaucgccgugagcauggccaacaucuuccgcggcuccuaccuggccggggcgggccuccuguucagcaucaugaagaacaccaccaacacccggcgcgggacgggcaacaucggcgagacccugggggagaaguggaagucccggcucaacgcccugggcaagagcgaguuccagaucuacaagaaguccgggauccaggaggucgaccgcacccuggccaaggagggcaucaagcgcggggagaccgaccaccacgccgugagccgcggcuccgccaagcuccggugguucguggagcgcaacauggucacgcccgagggcaaggugguggaccuggggugcggccgcgggggcuggagcuacuacugcgggggccugaagaacguccgcgaggugaagggccucaccaagggcggccccgggcacgaggagcccaucccgauguccaccuacggcuggaaccuggugcggcugcagagcggggucgacguguucuucacgccgcccgagaagugcgacacgcuccugugcgacaucggcgagagcucccccaacccgaccaucgaggcgggccgcacccugcgggugcucagccuggucgagaacuggcugaacaacgacacccaguucugcaucaaggugcucaaccccuacaugcccuccgugaucgagaagauggagacccugcagcgcaaguacgggggcgcccugguccggaacccgcugagccgcaacuccacgcacgagauguacugggugagcaacgccaccgggaacaucguguccagcgucaacaugaucucccggaugcucaucaaccgcuucaccaugaagcacaagaaggccaccuacgagcccgacguggaccugggcagcgggacgcggaacaucggcaucgaguccgagauccccaaccuggacaucaucggcaagcgcaucgagaagaucaagcaggagcacgagaccagcuggcacuacgaccaggaccaccccuacaagaccugggccuaccacggguccuacgagaccaagcagacgggcagcgcguccagcauggugaacggggucgugcgccuccugaccaagccgugggacgugguccccauggugacccagauggccaugaccgacacgacccccuucggccagcagcggguguucaaggagaaggucgacacccgcacccaggagcccaaggagggcacgaagaagcugaugaagaucaccgccgaguggcucuggaaggagcuggggaagaagaagaccccgcggaugugcacccgcgaggaguucacgcggaaggugcgcuccaacgccgcccugggcgcgaucuucaccgacgagaacaaguggaaguccgcccgggaggccguggaggacucccgcuucugggagcucgucgacaaggagcggaaccugcaccuggaggggaagugcgagaccugcguguacaacaugaugggcaagcgcgagaagaagcucggggaguucggcaaggccaagggcagccgggcgaucugguacauguggcugggggcccgcuuccuggaguucgaggcccucggcuuccugaacgaggaccacugguucagccgggagaacucccugagcgggguggagggcgaggggcuccacaagcugggcuacauccugcgcgacgucuccaagaaggagggcggggccauguacgccgacgacaccgcgggcugggacacgcggaucacccucgaggaccugaagaacgaggagauggugaccaaccacauggagggggagcacaagcgccuggccgaggccaucuucaagcucaccuaccagaacaaggugguccgggugcagcgccccacgccccggggcaccgucauggacaucaucagccgccgggaccagcgcggguccggccaggugggcaccuacgggcugaacaccuucacgaacauggaggcccagcugauccgccagauggagggcgaggggaucuucaagagcauccagcaccucaccgugaccgaggagaucgccguccagaacuggcuggcgcgggugggccgcgagcggcugucccgcauggccaucagcggcgacgacugcguggucaagccccucgacgaccgguucgccuccgcccugaccgcccugaacgacauggggaaggugcgcaaggacauccagcagugggagccgagcaagggcuggaacgacuggacccaggugcccuucugcucccaccacuuccacgagcucaucaugaaggacgggcggguccugguggugcccugccgcaaccaggacgagcugaucggccgggcgcgcaucagccagggggccggcuggucccucaaggagaccgccugccugggcaagagcuacgcccagauguggucccugauguacuuccaccggcgcgaccuccggcuggccgcgaacgccaucugcagcgccguccccucccacugggugccgaccagccgcaccaccuggagcauccacgccaagcacgaguggaugacgaccgaggacaugcugaccguguggaaccgggucuggauccaggagaaccccuggauggaggacaagacccccguggaguccugggaggaggugcccuaccucgggaagcgcgaggaccaguggugcggcagccugaucgggcugacgucccgggcgaccugggccaagaacauccagaccgccaucaaccagguccgcagccucaucggcaacgaggaguacaccgacuacaugccguccaugaagcgguuccgccgcgaggaggaggaggccggggugcugugguga

SEQ ID NO: 9574 - RNA, 9876 nt, Artificial Sequence
  derived and/or modified CDS sequence (opt1) from DENV-2__EU482663__SS-prME
agcgccgggaugaucaucaugcugauccccaccgugauggccuuccaccucaccacccggaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacguguucugcgacuccaagcugaugagcgccgccaucaaggacaaccgggccgugcacgcggacaugggguacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgccggccccgugagccagcacaacuaccgcccgggguaccacacccagaucgccggccccuggcaccuggggaagcuggagauggacuucgacuucugcgacggcaccaccgucaucgugacggaggacugcgggaaccggggccccucccuccgcaccaccaccgcgagcggcaagcugaucacggaguggugcugccggagcugcacccugcccccgcuccgcuaccgcggggaggacggcugcugguacgggauggagauccgcccccugaaggagaaggaggagaaccuggugaacucccucgucaccgccggccacggccagguggacaacuucagccugggcgugcugggcauggcccucuuccuggaggagaugcugcggacccgcgucgggacgaagcacgccauccuccugguggcgguguccuucgucacccugaucaccggcaacaugagcuucaaggaccucgggcgggugguggucauggugggcgccaccauggccgacgacaucgggaugggcgugacguaccuggcccugcucgccgcguucaagguccgccccaccuucgccgccggccugcugcuccggaagcugaccuccaaggagcugaugaugaccacgaucgggaucgugcuccugagccaguccaccauccccgagaccgugcuggagcucaccgacgcccuggcccugggcaugaugguccucaagaucgugcgcaacauggagaaguaccagcuggcggucacgaucauggccauccugugcgugccgaacgccgugauccuccagaacgccuggaaggucagcugcaccauccuggccgugguguccgucagcccccugcuccugaccuccagccagcagaagaccgacuggaucccccuggcgcucacgaucaaggggcugaaccccaccgccaucuuccugaccacccucucccgcacgaacaagaagcggagcuggccgcugaacgaggccaucauggccgugggcaugguguccauccuggcgagcucccuccugaagaacgacauccccaugaccggcccccuggucgccgggggccuccugaccgugugcuacgugcugaccgggcgcagcgccgaccucgagcuggagcgggccacggacgucaagugggaggaccaggccgagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgcggccgccugguaccugugggaggugaagaagcagcgggccgggguccucugggacgugcccagcccgccgcccaugggcaaggccgagcuggaggacggggcguaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcccuggagcccggcaagaacccccgggcggugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgccaucgcccagaccgagaaguccaucgaggacaaccccgagaucgaggacgacaucuuccggaagcgccggcugaccaucauggaccugcaccccggggcgggcaagacgaagcgcuaccuccccgccaucguccgggaggccaucaagcgcgggcugcggacccugauccucgccccgacccgcgugguggcggccgagauggaggaggcccugcggggccugcccauccgcuaccagacccccgccauccgggccgagcacacggggcgcgagaucgucgaccucaugugccacgcgaccuucaccaugcgccugcugagccccgugcgggugccgaacuacaaccucaucaucauggacgaggcccacuucaccgaccccgccuccaucgccgcccgcggcuacaucagcacgcgggucgagaugggcgaggcggccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggugugguucgucccgagcaucaaggccgggaacgacaucgcggccugccugcggaagaacggcaagaaggugauccagcugucccgcaagaccuucgacagcgaguacgugaagacccggaccaacgacugggacuucgucgugacgaccgacaucuccgagaugggcgccaacuucaaggccgagcgcgugaucgacccccggcgcugcaugaagcccgucauccucaccgacggggaggagcgggugauccuggcgggccccaugccggugacccacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacgcccgagggcaucaucccgagcauguucgagcccgagcgcgagaaggucgacgcgaucgacggcgaguaccggcugcgcggggaggcccgcaagaccuucguggaccucaugcggcgcggcgaccugcccguguggcuggccuacaaggucgccgccgaggggaucaacuacgcggaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgccggccgcaagagccugacccucaaccugaucacggagaugggccggcugcccaccuucaugacccagaagacccgcgacgcgcucgacaaccuggccgugcugcacacggccgaggccgggggccgggcguacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucacguacguggugaucgccauccugaccgucguggccgccaccauggcgaacgagaugggcuuccuggagaagaccaagaaggacuucgggcucggcuccaucgccacgcagcagccggagagcaacauccuggacaucgaccugcgccccgccuccgccuggacccucuacgccguggcgaccaccuucgucacgcccaugcugcggcacagcaucgagaacagcuccgugaacgugagccugaccgccaucgccaaccaggccaccguccucaugggccuggggaagggcuggccccuguccaagauggacaucggggugccgcuccuggccaucggcugcuacagccaggugaaccccaucacccugacggcggcccuccugcugcucgucgcccacuacgccaucaucgggcccggccugcaggcgaaggccacccgcgaggcccagaagcgggccgccgcgggcaucaugaagaaccccaccguggacgggaucaccgugaucgaccuggacccgauccccuacgaccccaaguucgagaagcagcucggccaggucaugcugcugauccucugcgugacccaggugcugaugaugcgcaccaccugggcccugugcgaggcccucacccuggccacggggcccaucuccacccugugggagggcaacccggggcgguucuggaacaccaccaucgccgucagcauggcgaacaucuuccgcggcuccuaccucgccggcgccgggcugcuguucagcaucaugaagaacacgaccaacacccggcgcggcaccgggaacaucggcgagacgcucggcgagaaguggaagucccgccugaacgcccuggggaaguccgaguuccagaucuacaagaaguccggcauccaggagguggaccggacccucgccaaggaggggaucaagcgcggcgagaccgaccaccacgcggugagccggggguccgccaagcugcgcugguucgucgagcggaacauggugacccccgagggcaagguggucgaccugggcugcgggcgcggcggguggagcuacuacugcggcgggcuccggaacgugcgcgaggugaagggccugacgaagggcgggcccggccacgaggagcccaucccgauguccaccuacggguggaaccugguccggcuccagagcggcguggacguguucuucaucccgcccgagaagugcgacacccugcugugcgacaucggggaguccagccccaacccgaccgucgaggccggccgcacgcuccgggugcugaaccugguggagaacuggcucaacaacaacacccaguucugcaucaagguccugaaccccuacaugcccuccgugaucgagaagauggaggcccugcagcgcaaguacggcggggcgcuggugcggaacccgcucagccgcaacagcacccacgagauguacugggucuccaacgccagcggcaacaucguguccagcgugaacaugaucucccggaugcugaucaaccgcuucaccaugcggcacaagaaggccaccuacgagcccgacgucgaccuggggagcggcacgcgcaacaucgggaucgaguccgagauccccaaccucgacaucaucggcaagcggaucgagaagaucaagcaggagcacgagaccagcuggcacuacgaccaggaccaccccuacaagaccugggccuaccacggcuccuacgagaccaagcagacggggagcgccuccagcauggugaacggcgugguccgccugcugaccaagccgugggacgugcuccccaccgugacccagauggcgaugacggacaccacccccuucgggcagcagcgcgucuucaaggagaagguggacacccggacgcaggagcccaaggagggcaccaagaagcugaugaagaucaccgccgaguggcuguggaaggagcucggcaagaagaagaccccgcgcaugugcacgcgggaggaguucacccgcaaggugcgguccaacgccgcccugggggccaucuucaccgacgagaacaaguggaaguccgcgcgcgaggccgucgaggacucccgguucugggagcugguggacaaggagcgcaaccuccaccuggagggcaagugcgagaccugcgucuacaacaugauggggaagcgggagaagaagcugggcgaguucgggaaggccaagggcagccgcgccaucugguacauguggcucggcgcccgguuccuggaguucgaggcgcugggguuccucaacgaggaccacugguucucccgcgagaacagccuguccggcguggagggggagggccugcacaagcucggguacauccugcgggacgugagcaagaaggagggcggcgccauguacgccgacgacacggccgggugggacacccgcaucacccuggaggaccucaagaacgaggagauggucaccaaccacauggagggcgagcacaagaagcuggcggaggccaucuucaagcugacguaccagaacaagguggugcggguccagcgccccacgccccgggggaccgugauggacaucaucagccgccgggaccagcgcggcuccggccagguggggaccuacggccucaacacguucaccaacauggaggcccagcugauccggcagauggagggggagggcgucuucaagaacauccagcaccugaccgugaccgaggagguggccguccagaacuggcucgcccgcguggggcgcgagcggcugagccgcauggcgaucuccggcgacgacugcguggucaagccccuggacgaccgguucgccaacgcccucacggcccugaacgacaugggcaagauccgcaaggacauccagcagugggagccgagcaagggguggaacgacuggacccaggugcccuucugcucccaccacuuccacgagcugaucaugaaggacggccgggugcucgucgugcccugccgcaaccaggacgagcugaucgggcgggcccgcaucagccagggcgcgggguggucccugcgggagaccgccugccucggcaagagcuacgcccagauguggucccugauguacuuccaccgccgggaccugcgccucgccgccaacgcgaucugcagcgccgugcccucccacugggucccgaccagccggacgaccugguccauccacgccaagcacgaguggaugaccaccgaggacaugcugaccguguggaaccgcguguggauccgggagaaccccuggauggaggacaagacgcccgucgagagcugggaggagauccccuaccugggcaagcgcgaggaccaguggugcgggucccucaucggccugaccagccgggccaccugggccaagaacauccaggcggccaucaaccaggugcgcucccugaucgggaacgaggaguacaucgacuacaugccgagcaugaagcgguuccgccgcgaggaggaggaggccggcgugcucugguga

SEQ ID NO: 9575 - RNA, 9876 nt, Artificial Sequence
  derived and/or modified CDS sequence (opt1) from DENV-2__EU482664__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacacgaucaccuacaagugcccccuccugcgccagaacgagcccgaggacaucgacugcuggugcaacagcaccagcaccugggugacguacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagacguggauccugcgccaccccggcuucaccaucauggcggccauccuggccuacaccaucgggaccacgcacuuccagcgggcccucaucuucauccugcugaccgcggucgcccccagcaugaccaugcgcugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccgcaaguacugcaucgaggcgaagcugacgaacaccaccaccgagucccggugcccgacgcagggcgagcccagccugaacgaggagcaggacaagcgcuucgucugcaagcacuccaugguggaccggggcugggggaacggcugcgggcuguucggcaagggcgggaucgugaccugcgccauguucacgugcaagaagaacauggagggcaagaucguccagcccgagaaccuggaguacaccaucgugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccgcaccggccucgacuucaacgagauggugcugcugcagauggaggacaaggccuggcucgugcaccggcagugguuccuggaccugccccuccccuggcugccgggggcggacacccagggcagcaacuggauccagaaggagacgcuggucaccuucaagaacccccacgccaagaagcaggacguggugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgcggagacccagcacgggacgaucgucauccgcgugcaguacgagggcgacggcucccccugcaagauccccuucgagaucauggaccuggagaagcggcacgugcucgggcgccugaucaccgucaacccgaucgugaccgagaaggacagccccgugaacaucgaggccgagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcgcuccaccagguguucggggccaucuacggcgccgccuucagcggggucuccuggaccaugaagauccugaucggcgcgaucaucacguggaucgggaugaacagccgcuccaccagccuguccgugagccuggugcucgucggcgugaucacccuguaccugggggccauggugcaggccgacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcgcacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggccaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgagaagcaggacguguucugcgacuccaagcugaugagcgcggccaucaaggacaaccgggccgugcacgccgacaugggcuacuggaucgaguccgcccucaacgacaccuggaagauggagaaggcgagcuucaucgaggucaaguccugccacuggcccaagagccacacccugugguccaacggcgugcuggagagcgagaugaucauccccaaguccuucgccgggcccgugagccagcacaacuaccgcccgggcuacuacacccagacggccgggcccuggcaccucggcaagcuggagauggacuucgacuucugcgaggggaccaccgucguggugaccgaggacugcggcaaccggggccccagccugcgcacgaccaccgccuccgggaagcucaucaccgaguggugcugccggagcugcacgcugcccccgcugcgcuaccggggcgaggacgggugcugguacggcauggagauccgcccccucaaggagaaggaggagaaccuggucaacucccuggugaccgcggggcacggccagaucgacaacuucagccucggcgugcuggggauggcccuguuccucgaggagaugcugcggacccgcgucggcaccaagcacgccauccugcucguggccguguccuucgucacgcugaucaccgggaacaugagcuuccgggaccugggccgcgugauggugauggucggggccaccaugaccgacgacaucggcaugggcgugacguaccucgcgcugcuggccgccuucaaggugcgccccaccuucgccgccgggcuccugcugcggaagcucaccuccaaggagcugaugauggcgaccaucggcaucgcccugcucagccaguccacgauccccgagaccauccuggagcugaccgacgcccucgcccuggggaugaugguccugaagaucgugcgcaacauggagaaguaccagcucgccgugaccaucauggcgaucagcugcgucccgaacgccgugauccugcagaacgccuggaagguguccugcacgauccuggccgcggucagcgugagcccccuccugcugaccagcucccagcagaaggccgacuggaucccccucgcccugaccaucaagggccugaaccccaccgccaucuuccucacgacccugagccggaccuccaagaagcgcagcuggccgcugaacgaggccaucauggcggugggcauggucuccauccucgccagcagccugcugaagaacgacauccccaugaccgggccccucguggccggcgggcugcugacggucugcuacgugcucaccggccgguccgccgaccuggagcuggagcgcgccaccgacgugaagugggaggaccaggcggagaucagcggguccagccccauccucuccaucaccaucagcgaggacggcuccaugagcaucaagaacgaggaggaggagcagacgcugaccauccugauccggaccggccuccuggucaucuccgggcuguucccggugagcauccccaucaccgccgccgccugguaccucugggaggugaagaagcagcgcgccggcguccugugggacgugcccagcccgccgcccguggggaaggcggagcuggaggacggcgccuaccggaucaagcagaaggggauccucggcuacagccagaucggcgccggggucuacaaggagggcaccuuccacacgauguggcacgugacccgcggggccgugcugaugcaccggggcaagcgcaucgagcccuccugggccgacgucaagaaggaccugaucagcuacgggggcggcuggaagcucgagggggaguggaaggagggcgaggagguccaggugcuggcgcuggagcccgggaagaacccccgggccguccagaccaagcccggccucuucaagaccaacacggggaccaucggcgccgugucccuggacuucagccccggcaccuccgggagccccaucguggaccgcaagggcaaggucguggggcuguacggcaacggcguggucacccgguccggggccuacgugagcgcgaucgcccagacggagaaguccaucgaggacaaccccgagaucgaggacgacaucuuccgcaagaagcggcucaccaucauggaccugcaccccggcgccgggaagaccaagcgcuaccugcccgccaucgugcgggaggccaucaagcgcggccugcggacccucauccuggcgccgacgcgcgucguggccgccgagauggaggaggcccugcgcgggcuccccauccgguaccagacccccgccauccgcgcggagcacaccggccgggagaucguggaccugaugugccacgccaccuucacgaugcgccugcucucccccguccgggugccgaacuacaaccugaucaucauggacgaggcccacuucaccgaccccgccagcaucgccgcgcgcggcuacaucuccacccggguggagaugggggaggccgccggcaucuucaugaccgccacgccgcccgggagccgcgacccguucccccaguccaacgcgcccaucaucgacgaggagcgggagauccccgagcgcagcuggaacuccggccacgagugggucaccgacuucaaggggaagaccgugugguucgugccgagcaucaaggccggcaacgacaucgccgccugccugcggaagaacggcaagaaggucauccagcucucccgcaagaccuucgacagcgaguacgugaagacgcggaccaacgacugggacuucguggucaccaccgacaucuccgagaugggggccaacuucaaggcggagcgcgugaucgacccccggcgcugcaugaagcccgugauccugacggacggcgaggagcgggucauccuggccgggcccaugccggugacccacagcuccgccgcccagcgccggggccgcaucgggcgcaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgggagaagguggacgccaucgacggggaguaccgccuccggggcgaggcccgcaagaccuucgucgaccugaugcggcgcggggaccugcccguguggcucgccuaccggguggccgcggagggcaucaacuacgccgaccgccgguggugcuucgacggggucaagaacaaccagauccuggaggagaacguggagguggagaucuggacgaaggagggcgagcgcaagaagcugaagccgcgguggcucgacgcccgcaucuacuccgacccccuggcccugaaggaguucaaggaguucgcggccggccggaagucccucacccugaaccugaucaccgagauggggcgccuccccaccuucaugacgcagaaggcccgggacgcccuggacaaccuggccguccuccacaccgcggaggccggcgggcgcgccuacaaccacgcccuguccgagcugcccgagacccucgagacccugcugcuccugacgcugcucgccaccgugaccggcggcaucuuccuguuccugaugagcgggaagggcguggggaagaugacccucggcaugugcugcaucaucaccgcguccauccugcugugguacgcccagauccagccgcacuggaucgccgccagcaucauccucgaguucuuccugaucguccugcucauccccgagcccgagaagcagcggacgccccaggacaaccagcugaccuacguggucaucgccauccugaccgugguggcggccaccauggccaacgagaugggguuccucgagaagacgaagaaggaccugggccugggcagcgucgccacccaggagccggaguccaacauccucgacaucgaccugcgccccgccagcgcguggacccuguacgccguggccaccacguucgugacccccaugcuccggcacuccaucgagaacagcuccgucaacgugagccugaccgccaucgcgaaccaggccaccgugcugauggggcucggcaagggguggccccuguccaagauggacaucggcgucccgcugcucgccaucgggugcuacagccaggugaaccccaucacgcugaccgccgcccugcuccugcugaucgcgcacuacgccaucaucggccccggccuccaggccaaggccacccgcgaggcccagaagcgggcggccgccgggaucaugaagaaccccaccguggacggcaucacggucaucgaccuggacccgauccccuacgaccccaaguucgagaagcagcugggccaggugaugcuccugauccugugcgugacccagguccucaugaugcgcaccaccugggcccugugcgaggcccugacgcucgcgaccggccccaucuccacccugugggaggggaacccgggccgcuucuggaacaccacgaucgccgugagcauggccaacaucuuccggggcuccuaccuggccggggcgggccuccuguucagcaucaugaagaacaccaccaacacccgccgggggacgggcaacaucggcgagacccugggggagaaguggaagucccgccucaacgcccugggcaagagcgaguuccagaucuacaagaaguccgggauccaggagguggaccggacccuggccaaggagggcaucaagcgcggggagaccgaccaccacgccgucagccggggcuccgccaagcuccgcugguucguggagcggaacauggugacgcccgagggcaaggucguggaccuggggugcggccgcgggggcuggagcuacuacugcgggggccugaagaacgugcgggaggucaagggccucaccaagggcggccccgggcacgaggagcccaucccgauguccaccuacggcuggaaccuggugcgccugcagagcgggguggacgucuucuucacgccgcccgagaagugcgacacgcuccugugcgacaucggcgagagcucccccaacccgaccaucgaggcgggccggacccugcgcgugcucagccugguggagaacuggcugaacaacgacacccaguucugcaucaagguccucaaccccuacaugcccuccgugaucgagaagauggagacccugcagcggaaguacgggggcgcccuggugcgcaacccgcugagccggaacuccacgcacgagauguacugggucagcaacgccaccgggaacaucguguccagcgugaacaugaucucccgcaugcucaucaaccgguucaccaugaagcacaagaaggccaccuacgagcccgacgucgaccugggcagcgggacgcgcaacaucggcaucgaguccgagauccccaaccuggacaucaucggcaagcgcaucgagaagaucaagcaggagcacgagaccagcuggcacuacgaccaggaccaccccuacaagaccugggccuaccacggguccuacgagaccaagcagacgggcagcgcguccagcauggugaacggggugguccggcuccugaccaagccgugggacguggugcccauggucacccagauggccaugaccgacacgacccccuucggccagcagcgcguguucaaggagaagguggacacccggacccaggagcccaaggagggcacgaagaagcugaugaagaucaccgccgaguggcucuggaaggagcuggggaagaagaagaccccgcgcaugugcacccgggaggaguucacgcgcaagguccgguccaacgccgcccugggcgcgaucuucaccgacgagaacaaguggaaguccgcccgcgaggccguggaggacucccgguucugggagcucguggacaaggagcgcaaccugcaccuggaggggaagugcgagaccugcgucuacaacaugaugggcaagcgggagaagaagcucggggaguucggcaaggccaagggcagccgcgcgaucugguacauguggcugggggcccgguuccuggaguucgaggcccucggcuuccugaacgaggaccacugguucagccgcgagaacucccugagcgggguggagggcgaggggcuccacaagcugggcuacauccugcgggacguguccaagaaggagggcggggccauguacgccgacgacaccgcgggcugggacacgcgcaucacccucgaggaccugaagaacgaggagauggucaccaaccacauggagggggagcacaagcggcuggccgaggccaucuucaagcucaccuaccagaacaaggugguccgcgugcagcggcccacgccccgcggcaccgugauggacaucaucagccggcgcgaccagcgcggguccggccaggucggcaccuacgggcugaacaccuucacgaacauggaggcccagcugauccggcagauggagggcgaggggaucuucaagagcauccagcaccucaccgugaccgaggagaucgccgugcagaacuggcuggcgcgcgucggccgggagcgccugucccggauggccaucagcggcgacgacugcguggugaagccccucgacgaccgcuucgccuccgcccugaccgcccugaacgacauggggaagguccggaaggacauccagcagugggagccgagcaagggcuggaacgacuggacccaggugcccuucugcucccaccacuuccacgagcucaucaugaaggacgggcgcgugcuggucgugcccugccggaaccaggacgagcugaucggccgcgcgcggaucagccagggggccggcuggucccucaaggagaccgccugccugggcaagagcuacgcccagauguggucccugauguacuuccaccgccgggaccuccgccuggccgcgaacgccaucugcagcgccgugcccucccacugggucccgaccagccggaccaccuggagcauccacgccaagcacgaguggaugacgaccgaggacaugcugaccguguggaaccgcguguggauccaggagaaccccuggauggaggacaagacccccgucgaguccugggaggaggugcccuaccucgggaagcgggaggaccaguggugcggcagccugaucgggcugacgucccgcgcgaccugggccaagaacauccagaccgccaucaaccaggugcggagccucaucggcaacgaggaguacaccgacuacaugccguccaugaagcgcuuccgccgggaggaggaggaggccgggguccugugguga

SEQ ID NO: 9576 - RNA, 9876 nt, Artificial Sequence
  derived and/or modified CDS sequence (opt1) from DENV-2__EU482665__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggacuucgggcucggcuccaucgccacgcagcagccggagagcaacauccuggacaucgaccugcgccccgccuccgccuggacccucuacgcgguggccaccaccuucgugacgcccaugcugcggcacagcaucgagaacagcuccgucaacgugagccugaccgccaucgccaaccaggccaccgugcucaugggccuggggaagggcuggccccuguccaagauggacaucggggucccgcuccuggcgaucggcugcuacagccaggugaaccccaucacccugacggccgcccuccugcugcucguggcccacuacgcgaucaucgggcccggccugcaggccaaggccacccgcgaggcccagaagcgggccgcggccggcaucaugaagaaccccaccgucgacgggaucaccgugaucgaccuggacccgauccccuacgaccccaaguucgagaagcagcucggccaggugaugcugcugauccucugcgucacccaggugcugaugaugcgcaccaccugggcccugugcgaggcccucacccuggccacggggcccaucuccacccugugggagggcaacccggggcgguucuggaacaccaccaucgcggugagcauggccaacaucuuccgcggcuccuaccucgccggcgccgggcugcuguucagcaucaugaagaacacgaccaacacccggcgcggcaccgggaacaucggcgagacgcucggcgagaaguggaagucccgccugaacgcccuggggaaguccgaguuccagaucuacaagaaguccggcauccaggaggucgaccggacccucgcgaaggaggggaucaagcgcggcgagaccgaccaccacgccgugagccggggguccgccaagcugcgcugguucguggagcggaacauggucacccccgagggcaaggugguggaccugggcugcgggcgcggcggguggagcuacuacugcggcgggcucaagaacguccgggaggugaagggccugacgaagggcgggcccggccacgaggagcccaucccgauguccaccuacggguggaaccuggugcgccuccagagcggcgucgacguguucuucaucccgcccgagaagugcgacacccugcugugcgacaucggggaguccagccccaacccgaccguggaggccggccggacgcuccgcguccugaaccugguggagaacuggcucaacaacaacacccaguucugcaucaaggugcugaaccccuacaugcccuccgucaucgagaagauggaggcgcugcagcggaaguacggcggggcccuggugcgcaacccgcucagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccuggggagcggcacgcggaacaucgggaucgaguccgagauccccaaccucgacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggucaacggcguggugcggcugcugaccaagccgugggacguccuccccaccgugacccagauggccaugacggacaccacccccuucgggcagcagcgcguguucaaggagaaggucgacacccgcacgcaggagcccaaggagggcaccaagaagcugaugaagaucaccgccgaguggcuguggaaggagcucggcaagaagaagaccccgcggaugugcacgcgcgaggaguucacccggaaggugcgcuccaacgccgcccugggggcgaucuucaccgacgagaacaaguggaaguccgcccgggaggccguggaggacucccgcuucugggagcuggucgacaaggagcggaaccuccaccuggagggcaagugcgagaccugcguguacaacaugauggggaagcgcgagaagaagcugggcgaguucgggaaggccaagggcagccgggccaucugguacauguggcucggcgcgcgcuuccuggaguucgaggcccugggguuccucaacgaggaccacugguucucccgggagaacagccuguccggcgucgagggggagggccugcacaagcucggguacauccugcgcgacgugagcaagaaggagggcggcgccauguacgccgacgacacggcggggugggacacccggaucacccuggaggaccucaagaacgaggagauggugaccaaccacauggagggcgagcacaagaagcuggccgaggccaucuucaagcugacguaccagaacaaggucgugcgcgugcagcggcccacgccccgggggaccgucauggacaucaucagccggcgcgaccagcggggcuccggccagguggggaccuacggccucaacacguucaccaacauggaggcccagcugauccgccagauggagggggagggcguguucaagaacauccagcaccugaccgucaccgaggagguggccgugcagaacuggcucgcgcgggucgggcgcgagcgccugagccggauggccaucuccggcgacgacugcguggugaagccccuggacgaccgcuucgccaacgcccucacggcccugaacgacaugggcaagauccggaaggacauccagcagugggagccgagcaagggguggaacgacuggacccagguccccuucugcucccaccacuuccacgagcugaucaugaaggacggccgcgugcucgugguccccugccggaaccaggacgagcugaucgggcgcgcgcggaucagccagggcgccggguggucccugcgcgagaccgccugccucggcaagagcuacgcccagauguggucccugauguacuuccaccggcgcgaccugcggcucgccgcgaacgccaucugcagcgccgugcccucccacugggugccgaccagccgcacgaccugguccauccacgccaagcacgaguggaugaccaccgaggacaugcugaccgucuggaaccggguguggauccgcgagaaccccuggauggaggacaagacgcccguggagagcugggaggagauccccuaccugggcaagcgggaggaccaguggugcgggucccucaucggccugaccagccgcgccaccugggcgaagaacauccaggccgccaucaaccagguccggucccugaucgggaacgaggaguacaccgacuacaugccgagcaugaagcgcuuccggcgcgaggaggaggaggccggcgugcucugguga

SEQ ID NO: 9577 - RNA, 9876 nt, Artificial Sequence
  derived and/or modified CDS sequence (opt1) from DENV-2__EU482666__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacacgaucaccuacaagugcccccuccugcgccagaacgagcccgaggacaucgacugcuggugcaacagcaccagcaccugggugacguacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagacguggauccugcgccaccccggcuucaccaucauggcggccauccuggccuacaccaucgggaccacgcacuuccagcgggcccucaucuucauccugcugaccgcggucgcccccagcaugaccaugcgcugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccgcaaguacugcaucgaggcgaagcugacgaacaccaccaccgagucccggugcccgacgcagggcgagcccagccugaacgaggagcaggacaagcgcuucgucugcaagcacuccaugguggaccggggcugggggaacggcugcgggcuguucggcaagggcgggaucgugaccugcgccauguucacgugcaagaagaacauggagggcaagaucguccagcccgagaaccuggaguacaccaucgugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccgcaccggccucgacuucaacgagauggugcugcugcagauggaggacaaggccuggcucgugcaccggcagugguuccuggaccugccccuccccuggcugccgggggcggacacccagggcagcaacuggauccagaaggagacgcuggucaccuucaagaacccccacgccaagaagcaggacguggugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgcggagacccagcacgggacgaucgucauccgcgugcaguacgagggcgacggcucccccugcaagauccccuucgagaucauggaccuggagaagcggcacgugcucgggcgccugaucaccgucaacccgaucgugaccgagaaggacagccccgugaacaucgaggccgagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcgcuccaccagguguucggggccaucuacggcgccgccuucagcggggucuccuggaccaugaagauccugaucggcgcgaucaucacguggaucgggaugaacagccgcuccaccagccuguccgugagccuggugcucgucggcgugaucacccuguaccugggggccauggugcaggccgacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcgcacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggccaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgagaagcaggacguguucugcgacuccaagcugaugagcgcggccaucaaggacaaccgggccgugcacgccgacaugggcuacuggaucgaguccgcccucaacgacaccuggaagauggagaaggcgagcuucaucgaggucaaguccugccacuggcccaagagccacacccugugguccaacggcgugcuggagagcgagaugaucauccccaaguccuucgccgggcccgugagccagcacaacuaccgcccgggcuaccacacccagacggccgggcccuggcaccucggcaagcuggagauggacuucgacuucugcgaggggaccaccgucguggugaccgaggacugcggcaaccggggccccagccugcgcacgaccaccgccuccgggaagcucaucaccgaguggugcugccggagcugcacgcugcccccgcugcgcuaccggggcgaggacgggugcugguacggcauggagauccgcccccucaaggagaaggaggagaaccuggucaacucccuggugaccgcggggcacggccagaucgacaacuucagccucggcgugcuggggauggcccuguuccucgaggagaugcugcggacccgcgucggcaccaagcacgccauccugcucguggccguguccuucaugacgcugaucaccgggaacaugagcuuccgggaccugggccgcgucauggugauggugggggccaccaugaccgacgacaucggcaugggcgucacguaccucgcgcugcuggccgccuucaaggugcgccccaccuucgccgccgggcuccugcugcggaagcucaccuccaaggagcugaugauggcgaccaucggcaucgcccugcucagccaguccacgauccccgagaccauccuggagcugaccgacgcccucgcccuggggaugauggugcugaagaucaugcgcaacauggagaaguaccagcucgccgucaccaucauggcgaucagcugcgugccgaacgccgugauccugcagaacgccuggaaggucuccugcacgauccuggccgcggugagcgugagcccccuccugcugaccagcucccagcagaaggccgacuggaucccccucgcccugaccaucaagggccugaaccccaccgccaucuuccucacgacccugagccggaccuccaagaagcgcagcuggccgcugaacgaggccaucauggcggucggcaugguguccauccucgccagcagccugcugaagaacgacauccccaugaccgggccccucguggccggcgggcugcugacggucugcuacgugcucaccggccgguccgccgaccuggagcuggagcgcgccaccgacgucaagugggaggaccaggcggagaucagcggguccagccccauccucuccaucaccaucagcgaggacggcuccaugagcaucaagaacgaggaggaggagcagacgcugaccauccugauccggaccggccuccuggugaucuccgggcuguucccggugagcauccccaucaccgccgccgccugguaccucugggaggucaagaagcagcgcgccggcgugcugugggacgugcccagcccgccgcccgucgggaaggcggagcuggaggacggcgccuaccggaucaagcagaaggggauccucggcuacagccagaucggcgccgggguguacaaggagggcaccuuccacacgauguggcacgugacccgcggggccguccugaugcaccggggcaagcgcaucgagcccuccugggccgacgugaagaaggaccugaucagcuacgggggcggcuggaagcucgagggggaguggaaggagggcgaggaggugcagguccuggcgcuggagcccgggaagaacccccgggccgugcagaccaagcccggccucuucaagaccaacacggggaccaucggcgccgugucccuggacuucagccccggcaccuccgggagccccaucgucgaccgcaagggcaaggugguggggcuguacggcaacggcgucgugacccgguccggggccuacgugagcgcgaucgcccagacggagaaguccaucgaggacaaccccgagaucgaggacgacaucuuccgcaagaagcggcucaccaucauggaccugcaccccggcgccgggaagaccaagcgcuaccugcccgccaucguccgggaggccaucaagcgcggccugcggacccucauccuggcgccgacgcgcgugguggccgccgagauggaggaggcccugcgcgggcuccccauccgguaccagacccccgccauccgcgcggagcacaccggccgggagaucgucgaccugaugugccacgccaccuucacgaugcgccugcucucccccgugcgggugccgaacuacaaccugaucaucauggacgaggcccacuucaccgaccccgccagcaucgccgcgcgcggcuacaucuccacccgggucgagaugggggaggccgccggcaucuucaugaccgccacgccgcccgggagccgcgacccguucccccaguccaacgcgcccaucaucgacgaggagcgggagauccccgagcgcagcuggaacuccggccacgagugggugaccgacuucaaggggaagaccgugugguucgucccgagcaucaaggccggcaacgacaucgccgccugccugcggaagaacggcaagaaggugauccagcucucccgcaagaccuucgacagcgaguacgugaagacgcggaccaacgacugggacuucgucgugaccaccgacaucuccgagaugggggccaacuucaaggcggagcgcgugaucgacccccggcgcugcaugaagcccgucauccugacggacggcgaggagcgggugauccuggccgggcccaugccggugacccacagcuccgccgcccagcgccggggccgcaucgggcgcaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgggagaaggucgacgccaucgacggggaguaccgccuccggggcgaggcccgcaagaccuucguggaccugaugcggcgcggggaccugcccguguggcucgccuaccgggucgccgcggagggcaucaacuacgccgaccgccgguggugcuucgacggggugaagaacaaccagauccuggaggagaacguggaggucgagaucuggacgaaggagggcgagcgcaagaagcugaagccgcgguggcucgacgcccgcaucuacuccgacccccuggcccugaaggaguucaaggaguucgcggccggccggaagucccucacccugaaccugaucaccgagauggggcgccuccccaccuucaugacgcagaaggcccgggacgcccuggacaaccuggccgugcuccacaccgcggaggccggcgggcgcgccuacaaccacgcccuguccgagcugcccgagacccucgagacccugcugcuccugacgcugcucgccaccgugaccggcggcaucuuccuguuccugaugagcgggaagggcgucgggaagaugacccucggcaugugcugcaucaucaccgcguccauccugcugugguacgcccagauccagccgcacuggaucgccgccagcaucauccucgaguucuuccugaucgugcugcucauccccgagcccgagaagcagcggacgccccaggacaaccagcugaccuacguggucaucgccauccugaccguggucgcggccaccauggccaacgagaugggguuccucgagaagacgaagaaggaccugggccugggcagcaucgccacccaggagccggaguccaacauccucgacaucgaccugcgccccgccagcgcguggacccuguacgccguggccaccacguucgugacccccaugcuccggcacuccaucgagaacagcuccgucaacgugagccugaccgccaucgcgaaccaggccaccgugcugauggggcucggcaagggguggccccuguccaagauggacaucggcgucccgcugcucgccaucgggugcuacagccaggugaaccccaucacgcugaccgccgcccugcuccugcugaucgcgcacuacgccaucaucggccccggccuccaggccaaggccacccgcgaggcccagaagcgggcggccgccgggaucaugaagaaccccaccguggacggcaucacggucaucgaccuggacccgauccccuacgaccccaaguucgagaagcagcugggccaggugaugcuccugauccugugcgugacccagguccucaugaugcgcaccaccugggcccugugcgaggcccugacgcucgcgaccggccccaucuccacccugugggaggggaacccgggccgcuucuggaacaccacgaucgccgugagcauggccaacaucuuccggggcuccuaccuggccggggcgggccuccuguucagcaucaugaagaacaccaccaacacccgccgggggacgggcaacaucggcgagacccugggggagaaguggaagucccgccucaacgcccugggcaagagcgaguuccagaucuacaagaaguccgggauccaggagguggaccggacccuggccaaggagggcaucaagcgcggggagaccgaccaccacgccgucagccggggcuccgccaagcuccgcugguucguggagcggaacauggugacgcccgagggcaaggucguggaccuggggugcggccgcgggggcuggagcuacuacugcgggggccugaagaacgugcgggaggucaagggccucaccaagggcggccccgggcacgaggagcccaucccgauguccaccuacggcuggaaccuggugcgccugcagagcgggguggacgucuucuucacgccgcccgagaagugcgacacgcuccugugcgacaucggcgagagcucccccaacccgaccaucgaggcgggccggacccugcgcgugcucagccugguggagaacuggcugaacaacgacacccaguucugcaucaagguccucaaccccuacaugcccuccgugaucgagaagauggagacccugcagcggaaguacgggggcgcccuggugcgcaacccgcugagccggaacuccacgcacgagauguacugggucagcaacgccaccgggaacaucguguccagcgugaacaugaucucccgcaugcucaucaaccgguucaccaugaagcacaagaaggccaccuacgagcccgacgucgaccugggcagcgggacgcgcaacaucggcaucgaguccgagauccccaaccuggacaucaucggcaagcgcaucgagaagaucaagcaggagcacgagaccagcuggcacuacgaccaggaccaccccuacaagaccugggccuaccacggguccuacgagaccaagcagacgggcagcgcguccagcauggugaacggggugguccggcuccugaccaagccgugggacguggugcccauggucacccagauggccaugaccgacacgacccccuucggccagcagcgcguguucaaggagaagguggacacccggacccaggagcccaaggagggcacgaagaagcugaugaagaucaccgccgaguggcucuggaaggagcuggggaagaagaagaccccgcgcaugugcacccgggaggaguucacgcgcaagguccgguccaacgccgcccugggcgcgaucuucaccgacgagaacaaguggaaguccgcccgcgaggccguggaggacucccgguucugggagcucguggacaaggagcgcaaccugcaccuggaggggaagugcgagaccugcgucuacaacaugaugggcaagcgggagaagaagcucggggaguucggcaaggccaagggcagccgcgcgaucugguacauguggcugggggcccgguuccuggaguucgaggcccucggcuuccugaacgaggaccacugguucagccgcgagaacucccugagcgggguggagggcgaggggcuccacaagcugggcuacauccugcgggacguguccaagaaggagggcggggccauguacgccgacgacaccgcgggcugggacacgcgcaucacccucgaggaccugaagaacgaggagauggucaccaaccacauggagggggagcacaagcggcuggccgaggccaucuucaagcucaccuaccagaacaagguggugcgcguccagcggcccacgccccgcggcaccgugauggacaucaucagccggcgcgaccagcgcggguccggccaggucggcaccuacgggcugaacaccuucacgaacauggaggcccagcugauccggcagauggagggcgaggggaucuucaagagcauccagcaccucaccgugaccgaggagaucgccgugcagaacuggcuggcgcgcgucggccgggagcgccugucccggauggccaucagcggcgacgacugcguggugaagccccucgacgaccgcuucgccuccgcccugaccgcccugaacgacauggggaagguccggaaggacauccagcagugggagccgagcaagggcuggaacgacuggacccaggugcccuucugcucccaccacuuccacgagcucaucaugaaggacgggcgcgugcuggucgugcccugccggaaccaggacgagcugaucggccgcgcgcggaucagccagggggccggcuggucccucaaggagaccgccugccugggcaagagcuacgcccagauguggucccugauguacuuccaccgccgggaccuccgccuggccgcgaacgccaucugcagcgccgugcccucccacugggucccgaccagccggaccaccuggagcauccacgccaagcacgaguggaugacgaccgaggacaugcugaccguguggaaccgcguguggauccaggagaaccccuggauggaggacaagacccccgucgaguccugggaggaggugcccuaccucgggaagcgggaggaccaguggugcggcagccugaucgggcugacgucccgcgcgaccugggccaagaacauccagaccgccaucaaccaggugcggagccucaucggcaacgaggaguacaccgacuacaugccguccaugaagcgcuuccgccgggaggaggaggaggccgggguccugugguga

SEQ ID NO: 9578 - RNA, 9876 nt, Artificial Sequence
  derived and/or modified CDS sequence (opt1) from DENV-2__EU482667__SS-prME
agcgcggggaugaucaucaugcugauccccaccgugauggccuuccaccucaccacccggaacggggagccccacaugaucguggggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacgcggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggaggcccuggucaccuucaagaacccccacgcgaagaagcaggacguggucgugcucggcagccaggagggggccaugcacaccgcccugacgggcgccaccgagauccagaugagcuccgggaaccuccucuucaccggccaccugaagugccggcugcgcauggacaagcuccagcugaagggcaugagcuacuccaugugcaccgggaaguucaagguggucaaggagaucgccgagacgcagcacggcaccaucgugaucaaggugcaguacgagggggacggcagccccugcaagauccccuucgagaucauggaccuggagaagcgguacguccucggccgccugaucaccgugaacccgaucgugaccgagaaggacucccccgucaacaucgaggcggagccgcccuucggggacagcuacaucaucaucggcguggagccggggcagcugaagcucaacugguucaagaagggcuccagcaucgggcagauguucgagacgaccaugcggggcgccaagcgcauggccauccugggcgacaccgccugggacuucgggucccugggcgggguguucaccagcaucggcaaggcccuccaccaggucuucggggcgaucuacggcgccgccuucuccggcgugagcuggacgaugaagauccugaucggggugaucaucaccuggaucggcaugaacucccgcagcaccucccugagcgucucccuggugcucguggggaucgucacccuguaccugggcgugauggugcaggccgacagcgggugcgucguguccuggaagaacaaggagcucaagugcggcagcggcaucuucaucacggacaacgugcacaccuggaccgagcaguacaaguuccagcccgagagccccuccaagcuggcgagcgccauccagaaggcccaggaggaggggaucugcggcauccgguccgucacccgccuggagaaccucauguggaagcagaucacgcccgagcugaaccacauccuggccgagaacgaggugaagcucaccaucaugaccggggacaucaagggcaucaugcaggccgggaagcggagccugcgcccgcagcccaccgagcugaaguacuccuggaagacguggggcaaggcgaagaugcucagcaccgaguccuacaaccagaccuuccugaucgacggccccgagaccgccgagugcccgaacacgaaccgggccuggaacagccuggagguggaggacuacggguucggcgucuucaccaccaacaucuggcucaagcugaaggagaagcaggacguguucugcgacuccaagcugaugagcgccgccaucaaggacaaccgcgcggugcacgccgacaugggguacuggaucgaguccgcccucaacgacaccuggaagaucgagaaggccagcuucaucgaggucaagaacugccacuggcccaagucccacacgcuguggagcaacggcgugcuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgucaucgugaccgaggacugcgggaaccgcggccccucccuccggacgaccaccgccagcggcaagcugaucaccgaguggugcugccgcagcugcacgcugcccccgcuccgguaccgcggggaggacggcugcugguacgggauggagauccggccccugaaggagaaggaggagaaccuggugaacucccucgucaccgccggccacggccagguggacaacuucagccugggcgugcugggcauggcccucuuccuggaggagaugcugcgcacccgggucgggaccaagcacgcgauccuccugguggccguguccuucgucacgcugaucaccggcaacaugagcuucaaggaccucgggcgcgugguggucauggugggcgccaccauggccgacgacaucgggaugggcgugaccuaccuggcccugcucgcggccuucaagguccggcccacguucgccgccggccugcugcuccgcaagcugaccuccaaggagcugaugaugaccaccaucgggaucgugcuccugagccaguccacgauccccgagaccgugcuggagcucaccgacgcccuggcgcugggcaugaugguccucaagaucgugcggaacauggagaaguaccagcuggccgucaccaucauggccauccugugcgugccgaacgccgugauccuccagaacgccuggaaggucagcugcacgauccuggcggugguguccgucagcccccugcuccugaccuccagccagcagaagaccgacuggaucccccuggcccucaccaucaaggggcugaaccccacggccaucuuccugaccacccucucccgcaccaacaagaagcgcagcuggccgcugaacgaggccaucauggcggugggcaugguguccauccuggccagcucccuccugaagaacgacauccccaugacgggcccccuggucgccgggggccuccugaccgugugcuacgugcugaccgggcggagcgccgaccucgagcuggagcgcgccaccgacgucaagugggaggaccaggcggagaucuccggcagcagccccauccuguccaucacgaucagcgaggacggguccaugagcaucaagaacgaggaggaggagcagacccucaccauccugauccggaccggccugcucgugaucuccggccuguucccgaucagcauccccaucacggccgccgccugguaccugugggaggugaagaagcagcgcgccgggguccucugggacgugcccagcccgccgcccaugggcaaggcggagcuggaggacggggccuaccggaucaagcagaagggcauccugggguacagccagaucggcgccggcguguacaaggaggggaccuuccacaccauguggcacgucacccgcggcgccgugcucaugcacaaggggaagcggaucgagcccuccugggccgacgugaagaaggaccugaucagcuacggcgggggcuggaagcuggagggcgaguggaaggagggggaggagguccaggugcucgcgcuggagcccggcaagaacccccgcgccgugcagaccaagcccgggcuguucaagacgaacaccggcaccaucggggccgucucccucgacuucagccccggcaccuccggcagccccaucaucgacaagaaggggaagguggugggccuguacgggaacggcgucgugacgcgguccggcgccuacgugagcgccaucgcgcagaccgagaaguccaucgaggacaaccccgagaucgaggacgacaucuuccgcaagcggcgccugaccaucauggaccugcaccccggggccggcaagaccaagcgguaccuccccgccaucguccgcgaggccaucaagcgggggcugcgcacgcugauccucgcgccgacccgggugguggccgccgagauggaggaggcccugcgcggccugcccauccgguaccagacccccgccauccgcgcggagcacaccgggcgggagaucgucgaccucaugugccacgccacguucaccaugcgccugcugagccccgugcgcgugccgaacuacaaccucaucaucauggacgaggcccacuucaccgaccccgccuccaucgccgcgcggggcuacaucagcacccgcgucgagaugggcgaggccgccgggaucuucaugacggccacgccgcccggcagccgggacccguucccccaguccaacgcccccaucaucgacgaggagcgcgagauccccgagcggagcuggaacuccgggcacgagugggugaccgacuucaagggcaagaccgugugguucgucccgagcaucaaggcggggaacgacaucgccgccugccugcgcaagaacggcaagaaggugauccagcugucccggaagacguucgacagcgaguacgugaagacccgcaccaacgacugggacuucgucgugaccacggacaucuccgagaugggcgccaacuucaaggcggagcgggugaucgacccccgccggugcaugaagcccgucauccucaccgacggggaggagcgcgugauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacccccgagggcaucaucccgagcauguucgagcccgagcgggagaaggucgacgccaucgacggcgaguaccgccugcgcggggaggcccgcaagacguucguggaccucaugcgccggggcgaccugcccguguggcuggccuacaaggucgccgcggaggggaucaacuacgccgaccgccgguggugcuucgacggcaucaagaacaaccagauccucgaggagaacguggaggucgagaucuggaccaaggagggggagcgcaagaagcugaagccgcgguggcuggacgcccgcaucuacuccgacccccucgcccugaaggaguucaaggaguucgccgcgggccggaagucccugacccucaaccugaucaccgagaugggccgccugcccacguucaugacccagaagacccgggacgcccucgacaaccuggccgugcugcacaccgccgaggccggcgggcgcgccuacaaccacgcccucuccgagcugcccgagacgcuggagacccuccugcugcucacccugcuggccaccgugaccggcgggaucuuccucuuccugaugagcgggcgggggaucgggaagaugacccuggggaugugcugcaucaucaccgccuccauccuccugugguacgcgcagauccagccgcacuggaucgccgccagcaucauccuggaguucuuccucaucguccugcugauccccgagcccgagaagcagcgcacgccccaggacaaccagcucaccuacguggugaucgccauccugacggucguggccgcgaccauggccaacgagaugggcuuccuggagaagaccaagaaggacuucgggcucggcuccaucgccacccagcagccggagagcaacauccuggacaucgaccugcggcccgccuccgccuggacgcucuacgcgguggccaccaccuucgucacccccaugcugcgccacagcaucgagaacagcuccgugaacgugagccugacggccaucgccaaccaggccaccguccucaugggccuggggaagggcuggccccuguccaagauggacaucggggugccgcuccuggcgaucggcugcuacagccaggugaaccccaucacccugaccgccgcccuccugcugcucgucgcccacuacgcgaucaucgggcccggccugcaggccaaggccacgcgggaggcccagaagcgcgccgcggccggcaucaugaagaaccccaccguggacgggaucaccgugaucgaccuggacccgauccccuacgaccccaaguucgagaagcagcucggccaggucaugcugcugauccucugcgugacccaggugcugaugaugcggacgaccugggcccugugcgaggcccucacccuggccaccgggcccaucuccacgcugugggagggcaacccggggcgcuucuggaacaccaccaucgcggucagcauggccaacaucuuccggggcuccuaccucgccggcgccgggcugcuguucagcaucaugaagaacaccacgaacacccgccggggcaccgggaacaucggcgagacccucggcgagaaguggaagucccgccugaacgcccugggcaagagcgaguuccagaucuacaagaaguccggcauccaggagguggaccgcacgcucgcgaaggaggggaucaagcggggcgagaccgaccaccacgccgugagccgcggguccgccaagcugcggugguucgucgagcgcaacauggugacccccgagggcaagguggucgaccugggcugcgggcggggcggguggagcuacuacugcggcgggcucaagaacgugcgcgaggugaagggccugaccaagggcgggcccggccacgaggagcccaucccgauguccacguacggguggaaccugguccggcuccagagcggcguggacguguucuucaucccgcccgagaagugcgacacccugcugugcgacaucggggaguccagccccaacccgaccgucgaggccggccgcacccuccgggugcugaaccugguggagaacuggcucaacaacaacacgcaguucugcaucaagguccugaaccccuacaugcccuccgugaucgagaagauggaggcgcugcagcgcaaguacggcggggcccuggugcggaacccgcucagccgcaacagcacccacgagauguacugggucuccaacgccagcggcaacaucguguccagcgugaacaugaucucccggaugcugaucaaccgcuucaccaugcggcacaagaaggccaccuacgagcccgacgucgaccuggggagcggcacccgcaacaucgggaucgaguccgagauccccaaccucgacaucaucggcaagcggaucgagaagaucaagcaggagcacgagacgagcuggcacuacgaccaggaccaccccuacaagaccugggccuaccacggcuccuacgagaccaagcagaccgggagcgcguccagcauggugaacggcgugguccgccugcugacgaagccgugggacgugcuccccaccgugacccagauggccaugaccgacacgacccccuucgggcagcagcgggucuucaaggagaagguggacacccgcacccaggagcccaaggagggcacgaagaagcugaugaagaucaccgccgaguggcuguggaaggagcucggcaagaagaagaccccgcgcaugugcacccgggaggaguucacgcgcaaggugcgguccaacgccgcccugggggcgaucuucaccgacgagaacaaguggaaguccgcccgcgaggccgucgaggacucccgguucugggagcugguggacaaggagcgcaaccuccaccuggagggcaagugcgagaccugcgucuacaacaugauggggaagcgggagaagaagcugggcgaguucgggaaggccaagggcagccgcgccaucugguacauguggcucggcgcgcgguuccuggaguucgaggcccugggguuccucaacgaggaccacugguucucccgcgagaacagccuguccggcguggagggggagggccugcacaagcucggguacauccugcgggacgugagcaagaaggagggcggcgccauguacgccgacgacaccgcggggugggacacgcgcaucacccuggaggaccucaagaacgaggagauggucaccaaccacauggagggcgagcacaagaagcuggccgaggccaucuucaagcugaccuaccagaacaagguggugcggguccagcgccccacgccccgggggaccgugauggacaucaucagccgccgggaccagcgcggcuccggccaggugggcaccuacggccucaacaccuucacgaacauggaggcccagcugauccggcagauggagggggagggcgucuucaagaacauccagcaccugaccgugaccgaggagguggccguccagaacuggcucgcgcgcguggggcgggagcgccugagccgcauggccaucuccggcgacgacugcguggucaagccccuggacgaccgguucgccaacgcccucaccgcccugaacgacaugggcaagauccgcaaggacauccagcagugggagccgagcaagggguggaacgacuggacgcagguccccuucugcucccaccacuuccacgagcugaucaugaaggacggccgggugcucgucgugcccugccgcaaccaggacgagcugaucgggcgggcgcgcaucagccagggcgccggguggucccugcgggagaccgccugccucggcaagagcuacgcccagauguggucccugauguacuuccaccgccgggaccugcgccucgccgcgaacgccaucugcagcgccgugcccucccacugggucccgaccagccggaccacgugguccauccacgccaagcacgaguggaugaccaccgaggacaugcugaccguguggaaccgcguguggauccgggagaaccccuggauggaggacaagacccccgucgagagcugggaggagauccccuaccugggcaagcgcgaggaccaguggugcgggucccucaucggccugacgagccgggccaccugggcgaagaacauccaggccgccaucaaccaggugcgcucccugaucgggaacgaggaguacaccgacuacaugccgagcaugaagcgguuccgccgggaggaggaggaggccggcgugcucugguga

SEQ ID NO: 9579 - RNA, 9876 nt, Artificial Sequence
  derived and/or modified CDS sequence (opt1) from DENV-2__EU482668__SS-prME
agcgcggggaugaucaucaugcugauccccaccgugauggccuuccaccucaccacccgcaacggggagccccacaugaucgucgggauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacauccgcggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggccaucauggcggucggcaugguguccauccuggccagcucccuccugaagaacgacauccccaugaccggcccccugguggccgggggccuccugaccgucugcuacgugcugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgucaucuccggccuguucccgaucagcauccccaucaccgccgccgccugguaccugugggaggugaagaagcagcgcgccggggugcucugggacguccccagcccgccgcccaugggcaaggcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccgggucguggccgccgagauggaggaggcccugcgcggccugcccauccgguaccagacccccgccauccgcgcggagcacacggggcgcgagaucguggaccucaugugccacgccaccuucaccaugcggcugcugagccccguccgcgugccgaacuacaaccucaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagacggugugguucgugccgagcaucaaggcggggaacgacaucgccgccugccugcgcaagaacggcaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccucaccgacggggaggagcgcgucauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaagguggacgccaucgacggcgaguaccgccugcgcggggaggcccggaagaccuucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccguccugcacacggccgaggccggcgggcgcgccuacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccggcccgccuccgccuggacccuguacgcgguggccaccaccuucgugacgcccaugcugcgccacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgggaggcccagaagcgcgccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacggggcccaucuccacccucugggagggcaacccggggcgcuucuggaacaccaccaucgcggugagcauggccaacaucuuccggggcuccuaccuggccggcgccgggcuccucuucagcaucaugaagaacacgaccaacacccgccgcggcaccgggaacaucggcgagacgcugggcgagaaguggaagucccggcugaacgcccucggcaagagcgaguuccagaucuacaagaaguccggcauccaggaggucgaccgcacccuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugacgaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgaccguggaggccggccgcacgcugcggguccugaaccucguggagaacuggcugaacaacaacacccaguucugcaucaaggugcugaaccccuacaugcccuccgucaucgagaagauggaggcgcugcagcgcaaguacggcggggcccucgugcggaacccgcugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgcguccagcauggucaacggcguggugcgccugcucaccaagccgugggacguccugcccaccgugacccagauggccaugacggacaccacccccuucgggcagcagcgcguguucaaggagaaggucgacacccggacgcaggagcccaaggagggcaccaagaagcugaugaagaucaccgccgaguggcucuggaaggagcugggcaagaagaagaccccgcgcaugugcacgcgggaggaguucacccgcaaggugcgguccaacgccgcccugggggcgaucuucaccgacgagaacaaguggaaguccgcccgcgaggccguggaggacucccgguucugggagcucgucgacaaggagcgcaaccugcaccuggagggcaagugcgagaccugcguguacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcgucgagggggagggccuccacaagcugggguacauccugcgggacgugagcaagaaggagggcggcgccauguacgccgacgacacggcggggugggacacccgcaucacccucgaggaccugaagaacgaggagauggugaccaaccacauggagggcgagcacaagaagcuggccgaggccaucuucaagcucacguaccagaacaaggucgugcgggugcagcgccccacgccccgggggaccgucauggacaucaucagccgccgggaccagcgcggcuccggccaggugggcaccuacggccugaacacguucaccaacauggaggcccagcugauccggcagauggagggggagggcguguucaagaacauccagcaccucaccgucaccgaggagguggccgugcacaacuggcuggcgcgcgucgggcgcgagcggcugagccgcauggccaucuccggcgacgacugcguggugaagccccucgacgaccgguucgccaacgcccugacggcccugaacgacaugggcaagauccgcaaggacauccagcagugggagccgagcaagggguggaacgacuggacccagguccccuucugcucccaccacuuccacgagcucaucaugaaggacggccggauccugguggugcccugccgcaaccaggacgagcugaucgggcgggcgcgcaucagccagggcgccggguggucccuccgggagaccgccugccugggcaagagcuacgcccagauguggucccugauguacuuccaccgccgggaccuccgccuggccgcgaacgccaucugcagcgccguccccucccacugggugccgaccagccggacgaccugguccauccacgccaagcacgaguggaugaccaccgaggacaugcugaccguguggaaccgcgucuggauccgggagaaccccuggauggaggacaagacgcccguggagagcugggaggagauccccuaccucggcaagcgcgaggaccaguggugcgggucccugaucggccugaccagccgggccaccugggcgaagaacauccaggccgccaucaaccaggugcgcucccucaucgggaacgaggaguacaccgacuacaugccgagcaugaagcgguuccgccgcgaggaggaggaggccggcguccugugguga

SEQ ID NO: 9580 - RNA, 9876 nt, Artificial Sequence
  derived and/or modified CDS sequence (opt1) from DENV-2__EU482669__SS-prME
agcgcgggcaugaucaucaugcugauccccaccgugauggccuuccaccucaccacccggaacggggagccccacaugaucgucggcauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccuccgccugggugaccuacgggaccugcacgaccaccggcgagcaccggcgggagaagcgcagcgucgcccuggugccccacguggggaugggccucgagacccggacggagaccuggauguccagcgagggggccuggaagcacgcccagcgcaucgagaccuggauccugcggcacccgggcuucaccaucauggcggccauccuggccuacacgaucgggaccacccacuuccagcgcguccucaucuucauccugcugaccgccguggcgcccuccaugacgaugcggugcaucggcaucagcaaccgcgacuucguggagggcgucuccgggggcagcuggguggacaucgugcucgagcacggguccugcgucaccaccauggccaagaacaagcccacccuggacuucgagcugaucaagacggaggccaagcagcccgccacccuccggaaguacugcaucgaggccaagcugaccaacaccacgaccgagagccgcugccccacccagggcgagcccucccugaaggaggagcaggacaagcgguucgugugcaagcacagcaugguggaccgcggcugggggaacggcugcggccuguucggcaagggcgggaucgugaccugcgcgauguucacgugcaagaagaacauggagggcaagaucgugcagcccgagaaccuggaguacaccaucguggucacgccccacuccggggaggagcacgccgugggcaacgacaccgggaagcacggcaaggagaucaaggugacgccgcagagcuccaucaccgaggucgagcugaccggguacggcaccgugaccauggagugcagcccccggacgggccucgacuucaacgagauggugcugcugcagauggagaacaaggccuggcucguccaccgccagugguuccuggaccugccccuccccuggcugccgggggccgacaagcaggaguccaacuggauccagaaggagacccuggugaccuucaagaacccccacgccaagaagcaggacgucguggugcucggcagccaggagggggcgaugcacaccgcccugacgggcgccaccgagauccagaugagcuccgggaaccuccuguucaccggccaccugaagugccggcugcgcauggacaagcuccagcugaagggcaugagcuacuccaugugcaccgggaaguucaaggucgugaaggagaucgccgagacgcagcacggcaccaucgugauccggguccaguacgagggggacggcagccccugcaagauccccuucgagaucauggaccuggagaagcgcuacgugcucggccggcugaucaccgugaacccgaucgucaccgagaaggacucccccgugaacaucgaggccgagccgcccuucggggacagcuacaucaucaucggcguggagccggggcagcugaagcucaacugguucaagaagggcuccagcaucgggcagauguucgagacgaccaugcgcggcgcgaagcgcauggccauccugggcgacaccgccugggacuucgggucccugggcggggucuucaccagcaucggcaaggcccuccaccagguguucggggccaucuacggcgcggccuucuccggcgugagcuggacgaugaagauccugaucggggucaucaucaccuggaucggcaugaacucccggagcaccucccugagcgugucccuggugcucgucgggaucgugacccuguaccugggcgugaugguccaggccgacagcgggugcgugguguccuggaagaacaaggagcucaagugcggcagcggcaucuucaucacggacaacguccacaccuggaccgagcaguacaaguuccagcccgagagccccuccaagcuggccagcgcgauccagaaggcccaggaggaggggaucugcggcauccgcuccgugacccggcuggagaaccucauguggaagcagaucacgcccgagcugaaccacauccuggccgagaacgaggugaagcucaccaucaugaccggggacaucaagggcaucaugcaggccgggaagcgcagccugcggccgcagcccaccgagcugaaguacuccuggaagacguggggcaaggccaagaugcucagcaccgaguccuacaaccagaccuuccugaucgacggccccgagaccgcggagugcccgaacacgaaccgcgccuggaacagccuggaggucgaggacuacggguucggcguguucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacaccuggaagaucgagaaggccagcuucaucgaggucaagaacugccacuggcccaagucccacacgcuguggagcaacggcgugcuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgucaucgugaccgaggacugcgggaaccggggccccucccuccgcacgaccaccgccagcggcaagcugaucaccgaguggugcugccggagcugcacgcugcccccgcuccgcuaccgcggggaggacggcugcugguacgggauggagauccgcccccugaaggagaaggaggagaaccuggugaacucccucgucaccgccggccacgggcaggucgacaacuucagccugggcgugcugggcauggcccucuuccuggaggagaugcugcggacccgcgucgggaccaagcacgcgauccuccugguggccguguccuucgucacgcugaucaccggcaacaugagcuucaaggaccucgggcgggugguggucauggugggcgccaccauggccgacgacaucgggaugggcgugaccuaccuggcccugcucgcggccuucaagguccgccccacguucgccgccggccugcugcuccggaagcugaccuccaaggagcugaugaugaccaccaucgggaucgugcuccugagccaguccacgauccccgagaccgugcuggagcucaccgacgcccuggcgcugggcaugaugguccucaagaucgugcgcaacauggagaaguaccagcuggccgucaccaucauggccauccugugcgugccgaacgccgugauccuccagaacgccuggaaggucagcugcacgauccuggcggugguguccgucagcccccugcuccugaccuccagccagcagaagaccgacuggaucccccuggcccucaccaucaaggggcugaaccccacggccaucuuccugaccacccucucccgcaccaacaagaagcggagcuggccgcugaacgaggccaucauggcggugggcaugguguccauccuggccagcucccuccugaagaacgacauccccaugacgggcccccuggucgccgggggccuccugaccgugugcuacgugcugaccgggcgcagcgccgaccucgagcuggagcgggccaccgacgucaagugggaggaccaggcggagaucuccggcagcagccccauccuguccaucacgaucagcgaggacggguccaugagcaucaagaacgaggaggaggagcagacccucaccauccugauccgcaccggccugcucgugaucuccggccuguucccgaucagcauccccaucacggccgccgccugguaccugugggaggugaagaagcagcgggccgggguccucugggacgugcccagcccgccgcccaugggcaaggcggagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcgcuggagcccggcaagaacccccgggccgugcagaccaagcccgggcuguucaagacgaacaccggcaccaucggggccgucucccucgacuucagccccggcaccuccggcagccccaucaucgacaagaaggggaagguggugggccuguacgggaacggcgucgugacgcgcuccggcgccuacgugagcgccaucgcgcagaccgagaaguccaucgaggacaaccccgagaucgaggacgacaucuuccggaagcgccggcugaccaucauggaccugcaccccggggccggcaagaccaagcgcuaccuccccgccaucguccgggaggccaucaagcgcgggcugcggacgcugauccucgcgccgacccgcgugguggccgccgagauggaggaggcccugcggggccugcccauccgcuaccagacccccgccaucaaggcggagcacaccgggcgggagaucgucgaccucaugugccacgccacguucaccaugcgccugcugagccccgugcgcgugccgaacuacaaccucaucaucauggacgaggcccacuucaccgaccccgccuccaucgccgcgcggggcuacaucagcacccgcgucgagaugggcgaggccgccgggaucuucaugacggccacgccgcccggcagccgggacccguucccccaguccaacgcccccaucaucgacgaggagcgcgagauccccgagcggagcuggaacuccgggcacgagugggugaccgacuacaagggcaagaccgugugguucgucccgagcaucaaggcggggaacgacaucgccgccugccugcgcaagaacggcaagaaggugauccagcugucccggaagacguucgacagcgaguacgugaagacccgcaccaacgacugggacuucgucgugaccacggacaucuccgagaugggcgccaacuucaaggcggagcgggugaucgacccccgccggugcaugaagcccgucauccucaccgacggggaggagcgcgugauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacccccgagggcaucaucccgagcauguucgagcccgagcgggagaaggucgacgccaucgacggcgaguaccgccugcgcggggaggcccgcaagacguucguggaccucaugcgccggggcgaccugcccguguggcuggccuacaaggucgccgcggaggggaucaacuacgccgaccgccgguggugcuucgacggcaucaagaacaaccagauccucgaggagaacguggaggucgagaucuggaccaaggagggggagcgcaagaagcugaagccgcgguggcuggacgcccgcaucuacuccgacccccucgcccugaaggaguucaaggaguucgccgcgggccggaagucccugacccucaaccugaucaccgagaugggccgccugcccacguucaugacccagaagacccgggacgcccucgacaaccuggccgugcugcacaccgccgaggccggcgggcgcgccuacaaccacgcccucuccgagcugcccgagacgcuggagacccuccugcugcucacccugcuggccaccgugaccggcgggaucuuccucuuccugaugagcgggcgggggaucggcaagaugacccuggggaugugcugcaucaucaccgccuccauccuccugugguacgcgcagauccagccgcacuggaucgccgccagcaucauccuggaguucuuccucaucguccugcugauccccgagcccgagaagcagcgcacgccccaggacaaccagcucaccuacguggugaucgccauccugacggucguggccgcgaccauggccaacgagaugggcuuccuggagaagaccaagaaggaccucgggcugggcuccaucgccacccagcagccggagagcaacauccuggacaucgaccuccggcccgccuccgccuggacgcuguacgcgguggccaccaccuucgucacccccaugcugcgccacagcaucgagaacagcuccgugaacgugagccucacggccaucgccaaccaggccaccguccugaugggccuggggaagggcuggccccucuccaagauggacaucggggugccgcugcuggcgaucggcugcuacagccaggugaaccccaucacccucaccgccgcccugcugcuccuggucgcccacuacgcgaucaucgggcccggccugcaggccaaggccacgcgggaggcccagaagcgcgccgcggccggcaucaugaagaaccccaccguggacgggaucaccgugaucgaccucgacccgauccccuacgaccccaaguucgagaagcagcugggccaggucaugcugcucauccugugcgugacccaggugcugaugaugcggacgaccugggcccucugcgaggcccugacccuggccaccgggcccaucuccacgcucugggagggcaacccggggcgcuucuggaacaccaccaucgcggucagcauggccaacaucuuccggggcuccuaccuggccggcgccgggcuccucuucagcaucaugaagaacaccacgaacacccgccggggcaccgggaacaucggcgagacccugggcgagaaguggaagucccgccugaacgcccucggcaagagcgaguuccagaucuacaagaaguccggcauccaggagguggaccgcacgcuggcgaaggaggggaucaagcggggcgagaccgaccaccacgccgugagccgcggguccgccaagcugcggugguucgucgagcgcaacauggugacccccgagggcaagguggucgaccucggcugcgggcggggcggguggagcuacuacugcggcgggcugaagaacgugcgcgaggugaagggccugaccaagggcgggcccggccacgaggagcccaucccgauguccacguacggguggaaccucguccggcugcagagcggcguggacguguucuucaucccgcccgagaagugcgacacccugcucugcgacaucggggaguccagccccaacccgaccgucgaggccggccgcacccugcgggugcugaaccucguggagaacuggcugaacaacaacacgcaguucugcaucaagguccugaaccccuacaugcccuccgugaucgagaagauggaggcgcugcagcgcaaguacggcggggcccucgugcggaacccgcugagccgcaacagcacccacgagauguacugggucuccaacgccagcggcaacaucguguccagcgugaacaugaucucccggaugcugaucaaccgcuucaccaugcggcacaagaaggccaccuacgagcccgacgucgaccucgggagcggcacccgcaacaucgggaucgaguccgagauccccaaccuggacaucaucggcaagcggaucgagaagaucaagcaggagcacgagacgagcuggcacuacgaccaggaccaccccuacaagaccugggccuaccacggcuccuacgagaccaagcagaccgggagcgcguccagcauggugaacggcgugguccgccugcucacgaagccgugggacgugcugcccaccgugacccagauggccaugaccgacacgacccccuucgggcagcagcgggucuucaaggagaagguggacacccgcacccaggagcccaaggagggcacgaagaagcugaugaagaucaccgccgaguggcucuggaaggagcugggcaagaagaagaccccgcgcaugugcacccgggaggaguucacgcgcaaggugcgguccaacgccgcccugggggcgaucuucaccgacgagaacaaguggaaguccgcccgcgaggccgucgaggacucccgguucugggagcucguggacaaggagcgcaaccugcaccuggagggcaagugcgagaccugcgucuacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcguggagggggagggccuccacaagcugggguacauccugcgggacgugagcaagaaggagggcggcgccauguacgccgacgacaccgcggggugggacacgcgcaucacccucgaggaccugaagaacgaggagauggucaccaaccacauggagggcgagcacaagaagcuggccgaggccaucuucaagcucaccuaccagaacaagguggugcggguccagcgccccacgccccgggggaccgugauggacaucaucagccgccgggaccagcgcggcuccggccagguggggaccuacggccugaacaccuucacgaacauggaggcccagcugauccggcagauggagggggagggcgucuucaagaccauccagcaccucaccgugaccgaggagguggccguccagaacuggcuggcgcgcguggggcgggagcgccugagccgcauggccaucuccggcgacgacugcguggucaagccccucgacgaccgguucgccaacgcccugacggcccugaacgacaugggcaagauccgcaaggacauccagcagugggagccgagcaagggguggaacgacuggacccaggugcccuucugcucccaccacuuccacgagcucaucaugaaggacggccgggugcuggucgugcccugccgcaaccaggacgagcugaucgggcgggcgcgcaucagccagggcgccggguggucccuccgggagaccgccugccugggcaagagcuacgcccagauguggucccugauguacuuccaccgccgggaccuccgccuggccgcgaacgccaucugcagcgccgugcccucccacugggucccgaccagccggacgaccugguccauccacgccaagcacgaguggaugaccaccgaggacaugcugaccguguggaaccgcguguggauccgggagaaccccuggauggaggacaagacgcccgucgagagcugggaggagauccccuaccucggcaagcgcgaggaccaguggugcgggucccugaucggccugaccagccgggccaccugggcgaagaacauccaggccgccaucaaccaggugcgcucccucaucgggaacgaggaguacaccgacuacaugccgagcaugaagcgguuccgccgggaggaggaggaggccggcgugcugugguga

SEQ ID NO: 9581 - RNA, 9876 nt, Artificial Sequence
  derived and/or modified CDS sequence (opt1) from DENV-2__EU482670__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaaggugaugaaggagaucgccgagacccagcacggcaccaucgucauccgggugcaguacgagggggacggcagccccugcaagauccccuucgagaucauggaccuggagaagcgcuacgugcucggccggcugaucaccgucaacccgaucgugacggagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccagguguucggggccaucuacggcgcggccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccacggagcugaaguacuccuggaagaccuggggcaaggccaagaugcucagcaccgagucccacaaccagaccuuccugaucgacggccccgagacggcggagugcccgaacaccaaccgcgccuggaacagccuggagguggaggacuacggguucggcguguucaccaccaacaucuggcucaagcugaaggagaagcaggacgccuucugcgacuccaagcugaugagcgccgccaucaaggacaaccgggcgguccacgccgacaugggguacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgccggccccgucagccagcacaacuaccgcccgggguaccacacccagguggcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacaugggcgagacgcugggcgagaaguggaagucccgccugaacgcccucgggaaguccgaguuccagaucuacaagaaguccggcauccaggaggucgaccggacccuggcgaaggaggggaucaagcgcggcgagaccgaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugacgaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgaccguggaggccggccggacgcugcgcguccugaaccucguggagaacuggcugaacaacaacacccaguucugcaucaaggugcugaaccccuacaugcccuccgucaucgagaagauggaggcgcugcagcggaaguacggcggggcccucgugcgcaacccgcugagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggucaacggcguggugcggcugcucaccaagccgugggacguccugcccaccgugacccagauggccaugacggacaccacccccuucgggcagcagcgcguguucaaggagaaggucgacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggcgaucuucaccgacgagaacaaguggaaguccgcccgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcgucgagggggagggccuccacaagcugggguacauccugcgcgacgugagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggucgugcgcgugcagcggcccacgccccgggggaccgucauggacaucaucagccggcgcgaccagcggggcuccggccagguggggaccuacggccugaacacguucaccaacauggaggcccagcugauccgccagauggagggggagggcguguucaagaacauccagcaccucaccgucaccgaggagguggccgugcagaacuggcuggcgcgggucgggcgcgagcgccugagccggauggccaucuccggcgacgacugcguggugaagccccucgacgaccgcuucgccaacgcccugacggcccugaacgacaugggcaagauccggaaggacauccagcagugggagccgagcaagggguggaacgacuggacccagguccccuucugcucccaccacuuccacgagcucaucaugaaggacggccgcauccugguggugcccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccguccccucccacugggugccgaccagccgcacgaccugguccauccacgccaagcacgaguggaugaccaccgaggacaugcugaccguguggaaccgggucuggauccgcgagaaccccuggauggaggacaagacgcccguggagagcugggaggagauccccuaccucggcaagcgggaggaccaguggugcgggucccugaucggccugaccagccgcgccaccugggcgaagaacauccaggccgccaucaaccaggugcggucccucaucgggaacgaggaguacaccgacuacaugccgagcaugaagcgcuuccggcgcgaggaggaggaggccggcguccugugguga

SEQ ID NO: 9582 - RNA, 9876 nt, Artificial Sequence
  derived and/or modified CDS sequence (opt1) from DENV-2__EU482671__SS-prME
agcgcggggaugaucaucaugcugauccccaccgugauggccuuccaccucaccacccgcaacggggagccccacaugaucguggggauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucaucugcaagcacagcaugguggaccgcggcugggggaacggcugcggccuguucggcaagggcgggaucgugacgugcgccauguucacgugcaagaagaacauggagggcaagaucguccagcccgagaaccuggaguacaccaucguggugacgccccacuccggggaggagcacgcggucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggagaacaaggccuggcucgugcaccgccagugguuccuggaccugccccuccccuggcugccgggggccgacaagcaggaguccaacuggauccagaaggagacccuggugaccuucaagaacccccacgccaagaagcaggacgucgugguccucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggugcgggagaucgccgagacccagcacggcaccaucgucauccgcgugcaguacgagggggacggcagccccugcaagauccccuucgagaucauggaccuggagaagcgguacgugcucggccgccugaucaccgucaacccgaucgugacggagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgcgaagcggauggccauccugggcgacaccgccugggacuucgggucccugggcgggguguucacgagcaucggcaaggcccuccaccagguguucggggccaucuacggcgcggccuucuccggcgucagcuggaccaugaagauccugaucggggugaucaucaccuggaucggcaugaacucccgcagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgguccgugacgcgccuggagaaccucauguggaagcagaucacccccgagcugaaccacauccuggccgagaacgaggucaagcucaccaucaugaccggggacaucaagggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcguguucaccaccaacaucuggcucaagcugaaggagaagcaggacgccuucugcgacuccaagcugaugagcgccgccaucaaggacaaccgcgcgguccacgccgacaugggguacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgccggccccgucagccagcacaacuaccggccgggguaccacacccagaucgcgggccccuggcaccuggggaagcuggagauggacuucgacuucugcgacggcaccaccgugaucgugacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggucaacucccucgugaccgccggccacggccagguggacaacuucagccugggcguccugggcauggcccucuuccuggaggagaugcugcgcacccggguggggacgaagcacgcgauccuccugguggccgucuccuucgugacccugaucaccggcaacaugagcuucaaggaccucgggcgcguggucgugauggugggcgccaccauggccgacgacaucgggaugggcgucacguaccuggcccugcucgcggccuucaaggugcggcccaccuucgccgccggccugcugcuccgcaagcugaccuccaaggagcugaugaugaccacgaucgggaucgugcuccugagccaguccaccauccccgagaccguccuggagcucaccgacgcccuggcgcugggcaugauggugcucaagaucgugcgcaacauggagaaguaccagcuggccgucacgaucauggccauccugugcgugccgaacgccgucauccuccagaacgccuggaaggugagcugcaccauccuggcgguggucuccgugagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggccaucauggcggugggcauggucuccauccuggccagcucccuccugaagaacgacauccccaugaccggcccccugguggccgggggccuccugaccgugugcuacguccugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgugaucuccggccuguucccgaucagcauccccaucaccgccgccgccugguaccugugggaggucaagaagcagcgcgccggggugcucugggacgugcccagcccgccgcccaugggcaaggcggagcuggaggacggggccuaccggaucaagcagaagggcauccugggguacagccagaucggcgccggcgucuacaaggaggggaccuuccacaccauguggcacgugacccgcggcgccgugcucaugcacaaggggaagcggaucgagcccuccugggccgacgucaagaaggaccugaucagcuacggcgggggcuggaagcuggagggcgaguggaaggagggggaggagguccaggugcucgcgcuggagcccggcaagaacccccgcgccguccagacgaagcccgggcuguucaagaccaacaccggcaccaucggggccgugucccucgacuucagccccggcacguccggcagccccaucaucgacaagaaggggaagguggucggccuguacgggaacggcguggugacccgguccggcgccuacgucagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccggguggucgccgccgagauggaggaggcccugcgcggccugcccauccgguaccagacccccgccauccgcgcggagcacacggggcgcgagaucguggaccucaugugccacgccaccuucaccaugcggcugcugagccccgugcgcgucccgaacuacaaccucaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggugaccgacuucaagggcaagacggucugguucgugccgagcaucaaggcggggaacgacaucgccgccugccugcgcaagaacggcaagaaggugauccagcugucccggaagaccuucgacagcgaguacgucaagacccgcaccaacgacugggacuucguggugacgaccgacaucuccgagaugggcgccaacuucaaggcggagcgggucaucgacccccgccggugcaugaagcccgugauccucaccgacggggaggagcgcgugauccuggccggccccaugccggucacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaagguggacgccaucgacggcgaguaccgccugcgcggggaggcccggaagaccuucguggaccucaugcgccggggcgaccugcccgucuggcuggccuacaagguggccgcggaggggaucaacuacgccgaccgccgguggugcuucgacggcaucaagaacaaccagauccucgaggagaacguggaggucgagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccgugcugcacacggccgaggccggcgggcgcgccuacaaccacgcccucuccgagcugcccgagacccuggagacccuccugcugcucacccugcuggccacggucaccgggggcaucuuccucuuccugaugagcggccgggggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucacguacguggucaucgccauccugaccgugguggccgcgaccauggccaacgagaugggcuuccuggagaagaccaagaaggaccucgggcugggcuccaucgccacgcagcagccggagagcaacauccuggacaucgaccuccggcccgccuccgccuggacccuguacgcggucgccaccaccuucgugacgcccaugcugcgccacagcaucgagaacagcuccgugaacgucagccucaccgccaucgccaaccaggccaccgugcugaugggccuggggaagggcuggccccucuccaagauggacaucggggugccgcugcuggcgaucggcugcuacagccaggucaaccccaucacccucacggccgcccugcugcuccugguggcccacuacgcgaucaucgggcccggccugcaggccaaggccacccgggaggcccagaagcgcgccgcggccggcaucaugaagaaccccaccguggacgggaucaccgucaucgaccucgacccgauccccuacgaccccaaguucgagaagcagcugggccaggugaugcugcucauccugugcgugacgcagguccugaugaugcggaccaccugggcccucugcgaggcccugacccuggccacggggcccaucuccacccucugggagggcaacccggggcgcuucuggaacaccaccaucgcggugagcauggccaacaucuuccggggcuccuaccuggccggcgccgggcuccucuucagcaucaugaagaacacgaccaacacccgccgcggcaccgggaacaugggcgagacgcugggcgagaaguggaagucccggcugaacgcccucggcaagagcgaguuccagaucuacaagcgcuccggcauccaggagguggaccggacccuggcgaaggaggggaucaagcgcggcgagaccgaccaccacgccgucagccggggguccgccaagcugcgcugguucguggagcggaacauggugacccccgagggcaaggucguggaccucggcugcgggcgcggcggguggagcuacuacugcggcgggcugaagaacgugcgggaggucaagggccugacgaagggcgggcccggccacgaggagcccaucccgauguccaccuacggguggaaccucgugcgccugcagagcggcguggacgucuucuucaucccgcccgagaagugcgacacccugcucugcgacaucggggaguccagccccaacccgaccguggaggccggccggacgcugcgcgugcugaaccucgucgagaacuggcugaacaacaacacccaguucugcaucaaggugcugaaccccuacaugcccuccgugaucgagaagauggaggcgcugcagcggaaguacggcggggcccucguccgcaacccgcugagccggaacagcacccacgagauguacuggguguccaacgccagcggcaacaucguguccagcgucaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggugaacggcgucgugcgccugcucaccaagccgugggacgugcugcccaccgucacccagauggccaugacggacaccacccccuucgggcagcagcggguguucaaggagaagguggacacccgcacgcaggagcccaaggagggcaccaagaagcugaugaagaucaccgccgaguggcucuggaaggagcugggcaagaagaagaccccgcggaugugcacgcgcgaggaguucacccggaagguccgcuccaacgccgcccugggggcgaucuucaccgacgagaacaaguggaaguccgcccgggaggccguggaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgucagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggugguccgcgugcagcggcccacgccccgcgggaccgugauggacaucaucagccggcgcgaccagcggggcuccgggcaggucggcaccuacggccugaacacguucaccaacauggaggcccagcugauccgccagauggagggggagggcguguucaagaacauccagcaccucaccgugaccgaggaggucgccgugcagaacuggcuggcgcgcguggggcgggagcgccugagccggauggccaucuccggcgacgacugcgucgugaagccccucgacgaccgcuucgccaacgcccugacggcccugaacgacaugggcaagauccggaaggacauccagcagugggagccgagcaagggguggaacgacuggacccaggugcccuucugcucccaccacuuccacgagcucaucaugaaggacggccgcguccugguggugcccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccguccccucccacugggugccgaccagccgcacgaccugguccauccacgccaagcacgaguggaugaccaccgaggacaugcugaccguguggaaccgggucuggauccgcgagaaccccuggauggaggacaagacgcccguggagagcugggaggagauccccuaccucggcaagcgggaggaccaguggugcgggucccugaucggccugaccagccgcgccaccugggcgaagaacauccaggccgccaucaaccaggugcggucccucaucgggaacgaggaguacaccgacuacaugccgagcaugaagcgcuuccgccgggaggaggaggaggccggcguccugugguga

SEQ ID NO: 9583 - RNA, 9876 nt, Artificial Sequence
  derived and/or modified CDS sequence (opt1) from DENV-2__EU482674__SS-prME
agcgccggcaugaucaucaugcugauccccaccgugauggccuuccaccucaccacccggaacggggagccccacaugaucgucagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacuccaccagcaccugggugaccuacgggaccugcaccaccaccggcgagcaccggcgggagaagcgcuccgucgcccuggugccccacgugggcauggggcucgagacccggaccgagaccuggaugagcuccgagggcgccuggaagcacgcccagcggaucgagaccuggauccugcggcacccgggguucacgaucauggccgcgauccuggccuacaccaucggcaccacccacuuccagcgcguccucaucuucauccugcugacggccguggcccccagcaugaccaugcggugcaucgggaucuccaaccgcgacuucguggagggcgucagcggcggguccuggguggacaucgugcucgagcacggcagcugcgucaccaccauggcgaagaacaagcccacgcuggacuucgagcugaucaagaccgaggccaagcagcccgccacccuccggaaguacugcaucgaggccaagcugaccaacacgaccaccgagucccgcugccccacccagggggagcccagccugaaggaggagcaggacaagcgguucgugugcaagcacuccaugguggaccgcggcuggggcaacgggugcggccucuucgggaagggcgggaucgucacgugcgccauguucacgugcaagaagaacauggagggcaagaucgugcagcccgagaaccuggaguacaccaucguggucacgccccacagcggcgaggagcacgcgguggggaacgacacgggcaagcacgggaaggagaucaaggugaccccgcaguccagcaucaccgaggccgagcugaccggcuacgggaccgucacgauggagugcagcccccggaccggccucgacuucaacgagauggugcugcugcagauggagaacaaggccuggcucgugcaccgccagugguuccuggaccugccccuccccuggcugccgggcgccgacaagcaggagagcaacuggauccagaaggagacccuggucaccuucaagaacccccacgccaagaagcaggacguggucgugcucgggagccaggagggcgcgaugcacacggcccugaccggggccaccgagauccagauguccagcggcaaccugcuguucaccgggcaccugaagugccggcugcgcauggacaagcuccagcugaagggcauguccuacagcaugugcacgggcaaguucaagguggucaaggagaucgccgagacccagcacgggaccaucgugauccgggugcaguacgagggcgacgggucccccugcaagauccccuucgagaucauggaccuggagaagcgcuacguccucggccggcugaucaccgugaacccgaucgugacggagaaggacagccccgucaacaucgaggccgagccgcccuucggcgacuccuacaucaucaucgggguggagccgggccagcugaagcucaacugguucaagaaggggagcuccaucggccagauguucgagaccaccaugcgcggggcgaagcgcauggccauccugggcgacaccgccugggacuucggcagccucggcgggguguucacguccaucgggaaggcccuccaccaggucuucggggccaucuacggggcggccuucagcggcguguccuggaccaugaagauccugaucggcgugaucaucaccuggaucgggaugaacagccgguccaccagccuguccgucagccuggugcucgugggcaucgucacgcuguaccugggggugauggugcaggccgacuccggcugcgucgugagcuggaagaacaaggagcucaagugcgggagcggcaucuucaucaccgacaacgugcacaccuggaccgagcaguacaaguuccagcccgagucccccagcaagcuggccuccgcgauccagaaggcccaggaggagggcaucugcgggauccgcagcgucacgcggcuggagaaccucauguggaagcagaucacccccgagcugaaccacauccuggccgagaacgaggugaagcucaccaucaugaccggcgacauccgcgggaucaugcaggccggcaagcggucccugcgcccgcagcccacggagcugaaguacagcuggaagaccugggggaaggccaagaugcucuccaccgagagcuacaaccagaccuuccugaucgacggccccgagacggcggagugcccgaacaccaaccgggccuggaacucccuggagguggaggacuacggcuucggggucuucaccaccaacaucuggcucaagcugaaggagaagcaggacgccuucugcgacagcaagcugauguccgccgccaucaaggacaaccgcgcggugcacgccgacaugggcuacuggaucgagagcgcccucaacgacacguggaagaucgagaaggccuccuucaucgaggugaagaacugccacuggcccaagagccacacccugugguccaacgggguccuggagagcgagaugaucauccccaagaaccucgccggccccgugucccagcacaacuaccggccgggcuaccacacccagaucgcggggcccuggcaccugggcaagcuggagauggacuucgacuucugcgacgggaccaccgugaucgucacggaggacugcggcaaccgcgggcccagccuccggaccaccaccgccagcggcaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccaggucgacaacuucucccugggggugcugggcauggcccucuuccuggaggagaugcugcgcacccgggugggcacgaagcacgcgauccuccuggucgccgugagcuucgugacccugaucaccgggaacauguccuucaaggaccucggccgcgucguggugauggucggggccaccauggccgacgacaucggcaugggggugacguaccuggcccugcucgcggccuucaaggugcggcccaccuucgccgccggccugcugcuccgcaagcugaccagcaaggagcugaugaugaccacgaucggcaucguccuccugucccagagcaccauccccgagaccgugcuggagcucaccgacgcccuggcgcuggggaugauggugcucaagaucguccgcaacauggagaaguaccagcuggccgugacgaucauggccauccugugcgucccgaacgccgugauccuccagaacgccuggaagguguccugcaccauccuggcggucgugagcgugagcccccugcuccugaccagcucccagcagaagaccgacuggaucccccuggcccucacgaucaagggccugaaccccaccgccaucuuccugaccacccucagccggacgaacaagaagcgcuccuggccgcugaacgaggccaucauggcggucgggauggugagcauccuggccuccagccuccugaagaacgacauccccaugaccggcccccugguggccggcgggcuccugaccgucugcuacgugcugaccggccgguccgccgaccucgagcuggagcgcgccacggacgugaagugggaggaccaggcggagaucagcgggagcucccccauccugagcaucaccaucuccgaggacggcagcauguccaucaagaacgaggaggaggagcagacccucaccauccugauccggacggggcugcucgucaucagcggccuguucccgaucuccauccccaucaccgccgccgccugguaccugugggaggugaagaagcagcgcgccggcgugcucugggacguccccuccccgccgcccauggggaaggcggagcuggaggacggcgccuaccggaucaagcagaaggggauccugggccacucccagaucggggccggcguguacaaggagggcaccuuccacaccauguggcacgugacccgcggggccguccucaugcacaagggcaagcggaucgagcccagcugggccgacgugaagaaggaccugaucuccuacgggggcggguggaagcuggagggcgaguggaaggagggcgaggaggugcagguccucgcgcuggagcccgggaagaacccccgcgccgugcagacgaagcccggccuguucaagaccaacaccgggaccaucggcgccgugagccucgacuucucccccgggacgagcggcucccccaucaucgacaagaagggcaaggucguggggcuguacggcaacgggguggucacccggagcggcgccuacguguccgccaucgcgcagaccgagaagaacaucgaggacaaccccgagaucgaggacgacaucuuccgcaagcggcgccugaccaucauggaccugcaccccggcgccgggaagacgaagcgguaccuccccgccaucgugcgcgaggccaucaagcggggccugcgcacccugauccucgcgccgacccgggucguggccgccgagauggaggaggcccugcgcgggcugcccauccgguaccagacccccgccauccgcgcggagcacacgggccgcgagaucguggaccucaugugccacgccaccuucaccaugcggcugcugagccccguccgcgugccgaacuacaaccucaucaucauggacgaggcccacuucaccgaccccgccuccaucgccgcgcggggguacaucagcacgcgcguggagaugggcgaggccgccggcaucuucaugaccgccacgccgcccgggagccgggacccguucccccaguccaacgcccccaucaucgacgaggagcgcgagauccccgagcggagcuggaacuccggccacgagugggucaccgacuucaaggggaagacggugugguucgugccgagcaucaaggcgggcaacgacaucgccgccugccugcgcaagaacgggaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccucaccgacggcgaggagcgcgucauccuggccgggcccaugccggugacccacagcuccgccgcccagcggcgcggccggaucgggcgcaaccccaagaacgagaacgaccaguacaucuacaugggcgagccccuggagaacgacgaggacugcgcccacuggaaggaggcgaagaugcuccuggacaacaucaacacgcccgaggggaucaucccgagcauguucgagcccgagcgggagaagguggacgccaucgacggcgaguaccgccugcgcggcgaggcccggaagaccuucgucgaccucaugcgccgcggggaccugcccguguggcuggccuacaagguggccgcggagggcaucaacuacgccgaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcggggcggaagucccugacccucaaccugaucacggagaugggccgccugcccaccuucaugacccagaagacccgggacgcccucgacaaccuggccguccugcacacggccgaggcgggcgggcgcgccuacaaccacgcccucuccgagcugcccgagacccuggagacccuccugcugcucacccugcuggccacggugaccggcgggaucuuccucuuccugaugagcggccggggcaucgggaagaugacccugggcaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucacguacgucgugaucgccauccugaccguggucgccgcgaccauggccaacgagaugggguuccuggagaagaccaagaaggaccucggccugggguccaucgccacgcagcagccggagagcaacauccuggacaucgaccuccggcccgccuccgccuggacccuguacgcgguggccaccaccuucgugacgcccaugcugcgccacagcaucgagaacagcuccgucaacgugagccucaccgccaucgccaaccaggccaccgugcugaugggccugggcaagggguggccccucuccaagauggacaucggcgucccgcugcuggcgaucgggugcuacagccaggugaaccccaucacccucacggccgcccugcugcuccugguggcccacuacgcgaucaucggccccgggcugcaggccaaggccacccgggaggcccagaagcgcgccgcggccggcaucaugaagaaccccaccgucgacggcaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacgggccccaucuccacccucugggaggggaacccgggccgcuucuggaacaccaccaucgcggugagcauggccaacaucuuccggggguccuaccuggccggcgccggccuccuguucagcaucaugaagaacacgaccaacacccgccgcgggaccggcaacaucggggagacgcugggcgagaaguggaagucccggcugaacgcccucggcaagagcgaguuccagaucuacaagaaguccgggauccaggaggucgaccgcacccuggcgaaggagggcaucaagcgcggggagaccgaccaccacgccgugagccgcggcuccgccaagcugcggugguucguggagcgcaacauggucacccccgaggggaaggugguggaccucggcugcggccgcggcggguggagcuacuacugcggcgggcugaagaacguccgcgaggugaaggggcugacgaagggcgggcccgggcacgaggagcccaucccgauguccaccuacggcuggaaccucgugcggcugcagagcggggucgacguguucuucaucccgcccgagaagugcgacacccugcucugcgacaucggcgaguccagccccaacccgaccguggaggccgggcgcacgcugcggguccugaaccucguggagaacuggcugaacaacaacacccaguucugcaucaaggugcugaaccccuacaugcccuccgucaucgagaagauggaggcgcugcagcgcaaguacggcggcgcccucgugcggaacccgcugagccgcaacagcacccacgagauguacuggguguccaacgccagcgggaacaucgucuccagcgugaacaugaucucccggaugcugaucaaccgcuucaccaugcggcacaagaaggccaccuacgagcccgacguggaccucggcagcgggacgcgcaacaucggcaucgaguccgagaagcccaaccuggacaucaucgggaagcggaucgagaagaucaagcaggagcacgagaccagcuggcacuacgaccaggaccaccccuacaagaccugggccuaccacggcuccuacgagaccaagcagacgggcagcgcguccagcauggucaacgggguggugcgccugcucaccaagccgugggacguccugcccaccgugacccagauggccaugacggacaccacccccuucggccagcagcgcguguucaaggagaaggucgacacccggacgcaggagcccaaggaggggaccaagaagcugaugaagaucaccgccgaguggcucuggaaggagcugggcaagaagaagaccccgcgcaugugcacgcgggaggaguucacccgcaaggugcgguccaacgccgcccugggcgcgaucuucaccgacgagaacaaguggaaguccgcccgcgaggccguggaggacucccgguucugggagcucgucgacaaggagcgcaaccugcaccuggaggggaagugcgagaccugcguguacaacaugaugggcaagcgggagaagaagcucggggaguucggcaaggccaaggggagccgcgccaucugguacauguggcugggcgcgcgguuccuggaguucgaggcccucggcuuccugaacgaggaccacugguucucccgcgagaacagccuguccggggucgagggcgaggggcuccacaagcugggcuacauccugcgggacgugagcaagaaggagggcggggccauguacgccgacgacacggcgggcugggacacccgcaucacccucgaggaccugaagaacgaggagauggugaccaaccacauggagggggagcacaagaagcuggccgaggccaucuucaagcucacguaccagaacaaggucgugcgggugcagcgccccacgccccggggcaccgucauggacaucaucagccgccgggaccagcgcggguccggccagguggggaccuacggccugaacacguucaccaacauggaggcccagcugauccggcagauggagggcgaggggguguucaagaacauccagcaccucaccgucaccgaggagguggccgugcacaacuggcuggcgcgcgucggccgcgagcggcugagccgcauggccaucuccggggacgacugcguggugaagccccucgacgaccgguucgccaacgcccugacggcccugaacgacaugggcaagauccgcaaggacauccagcagugggagccgagcaagggcuggaacgacuggacccagguccccuucugcucccaccacuuccacgagcucaucaugaaggacgggcgggugcuggugguccccugccgcaaccaggacgagcugaucggccgggcgcgcaucagccagggggccggcuggucccuccgggagaccgccugccugggcaagagcuacgcccagauguggucccugauguacuuccaccgccgggaccuccgccuggccgcgaacgccaucugcagcgccgugcccucccacugggugccgaccagccggacgaccugguccauccacgccaagcacgaguggaugaccaccgaggacaugcugaccgucuggaaccgcguguggauccgggagaaccccuggauggaggacaagacgcccguggagagcugggaggagauccccuaccucggcaagcgcgaggaccaguggugcggcucccugaucgggcugaccagccgggccaccugggcgaagaacauccaggccgccaucaaccagguccgcucccucaucggcaacgaggaguacaccgacuacaugccgagcaugaagcgguuccgccgcgaggaggaggaggccggggugcugugguga

SEQ ID NO: 9584 - RNA, 9876 nt, Artificial Sequence
  derived and/or modified CDS sequence (opt1) from DENV-2__EU482676__SS-prME
agcgccagcaugaucaucaugcugauccccaccgugauggccuuccaccucaccacccgcaacggcgagccccacaugaucgucgggauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcuccgucgcccuggugccccacgugggcauggggcucgagacccggaccgagaccuggaugagcuccgagggcgccuggaagcacgcccagcgcaucgagaccuggauccugcggcacccgggguucacgaucauggccgcgauccuggccuacaccaucggcaccacccacuuccagcgcguccucaucuucauccugcugacggccguggcccccagcaugaccaugcggugcaucgggaucuccaaccgcgacuucguggagggcgucagcggcggguccuggguggacaucgugcucgagcacggcagcugcgucaccaccauggcgaagaacaagcccacgcuggacuucgagcugaucaagaccgaggccaagcagcccgccacccuccggaaguacugcaucaaggccaagcugaccaacacgaccaccgagucccgcugccccacccagggggagcccagccugaaggaggagcaggacaagcgguucgugugcaagcacuccaugguggaccgcggcuggggcaacgggugcggccucuucgggaagggcgggaucgucacgugcgccauguucacgugcaagaagaacauggagggccggaucgugcagcccgagaaccuggaguacaccaucguggucacgccccacagcggcgaggagcacgcgguggggaacgacacgggcaagcacgggaaggagaucaaggugaccccgcaguccagcaucaccgaggccgagcugaccggcuacgggaccgucacgauggagugcagcccccggaccggccucgacuucaacgagauggugcugcugcagauggagaacaaggccuggcucgugcaccggcagugguuccuggaccugccccuccccuggcugccgggcgccgacaagcaggagagcaacuggauccagaaggagacccuggucaccuucaagaacccccacgccaagaagcaggacguggucgugcucgggagccaggagggcgcgaugcacacggcccugaccggggccaccgagauccagauguccagcggcaaccugcuguucaccgggcaccugaagugccgccugcggauggacaagcuccagcugaagggcauguccuacagcaugugcacgggcaaguucaagguggucaaggagaucgccgagacccagcacgggaccaucgugauccgcgugcaguacgagggcgacgggucccccugcaagauccccuucgagaucauggaccuggagaagcgguacguccucggccgccugaucaccgugaacccgaucgugacggagaaggacagccccgucaacaucgaggccgagccgcccuucggcgacuccuacaucaucaucgggguggagccgggccagcugaagcucaacugguucaagaaggggagcuccaucggccagauguucgagaccaccaugcgcggggcgaagcggauggccauccugggcgacaccgccugggacuucggcagccucggcgggguguucacguccaucgggaaggcccuccaccaggucuucggggccaucuacggggcggccuucagcggcguguccuggaccaugaagauccugaucggcgugaucaucaccuggaucgggaugaacagccgcuccaccagccuguccgucagccuggugcucgugggcaucgucacgcuguaccugggggugauggugcaggccgacuccggcugcgucgugagcuggaagaacaaggagcucaagugcgggagcggcaucuucaucaccgacaacgugcacaccuggaccgagcaguacaaguuccagcccgagucccccagcaagcuggccuccgcgauccagaaggcccaggaggagggcaucugcgggauccggagcgucacgcgccuggagaaccucauguggaagcagaucacccccgagcugaaccacauccuggccgagaacgaggugaagcucaccaucaugaccggcgacaucaaggggaucaugcaggccggcaagcggucccugcgcccgcagcccacggagcugaaguacagcuggaagaccugggggaaggccaagaugcucuccaccgagagcuacaaccagaccuuccugaucgacggccccgagacggcggagugcccgaacaccaaccgggccuggaacucccuggagguggaggacuacggcuucggggucuucaccaccaacaucuggcucaagcugaaggagaagcaggacguguucugcgacagcaagcugauguccgccgccaucaaggacaaccgcgccgugcacgcggacaugggcuacuggaucgagagcgcccucaacgacacguggaagaucgagcgggccuccuucaucgaggucaagaacugccacuggcccaagagccacacccugugguccaacggggugcuggagagcgagaugaucauccccaagaaccucgccggccccgugucccagcacaacuaccgcccgggcuaccacacccagaucgccgggcccuggcaccugggcaagcuggagauggacuucgacuucugcgacgggaccaccgucaucgugacggaggacugcggcaaccgggggcccagccuccgcaccaccaccgcgagcggcaagcugaucacggaguggugcugccgguccugcacccugcccccgcuccgcuaccggggcgaggacgggugcugguacggcauggagauccgcccccugaaggagaaggaggagaaccuggugaacagccucgucaccgccgggcacggccagguggacaacuucucccugggggugcugggcauggcccucuuccuggaggagaugcugcggacccgcgucggcacgaagcacgccauccuccugguggcggugagcuucgucacccugaucaccgggaacauguccuucaaggaccucggccgggugguggucauggugggggccaccauggccgacgacaucggcaugggggugacguaccuggcccugcucgccgcguucaagguccgccccaccuucgccgccggccugcugcuccgcaagcugaccagcaaggagcugaugaugaccacgaucggcaucgugcuccugucccagagcaccauccccgagaccgugcuggagcucaccgacgcccuggcccuggggaugaugguccucaagaucgugcggaacauggagaaguaccagcuggcggucacgaucauggccauccugugcgugccgaacgccgugauccuccagaacgccuggaaggucuccugcaccauccuggccguggugagcgucagcccccugcuccugaccagcucccagcagaagaccgacuggaucccccuggcgcucacgaucaagggccugaaccccaccgccaucuuccugaccacccucagccgcacgaacaagaagcgguccuggccgcugaacgaggccaucauggccguggggauggugagcauccuggcguccagccuccugaagaacgacauccccaugaccggcccccuggucgccggcgggcuccugaccgugugcuacgugcugaccggccgcuccgccgaccucgagcuggagcgggccacggacgucaagugggaggaccaggccgagaucagcgggagcucccccauccugagcaucaccaucuccgaggacggcagcauguccaucaagaacgaggaggaggagcagacccucaccauccugauccgcacggggcugcucgugaucagcggccuguucccgaucuccauccccaucaccgcggccgccugguaccugugggaggugaagaagcagcgggccggcguccucugggacgugcccuccccgccgcccauggggaaggccgagcuggaggacggcgcguaccgcaucaagcagaaggggauccugggcuacucccagaucggggccggcguguacaaggagggcaccuuccacaccauguggcacgucacccgcggggccgugcucaugcacaagggcaagcgcaucgagcccagcugggccgacgugaagaaggaccugaucuccuacgggggcggguggaagcuggagggcgaguggaaggagggcgaggagguccaggugcucgcccuggagcccgggaagaacccccgggcggugcagacgaagcccggccuguucaagaccaacaccgggaccaucggcgccgucagccucgacuucucccccgggacgagcggcucccccaucaucgacaagaagggcaaggugguggggcuguacggcaacggggucgugacccgcagcggcgccuacguguccgccaucgcccagaccgagaaguccaucgaggacaaccccgagaucgaggacgacaucuuccggaagcgccggcugaccaucauggaccugcaccccggcgcggggaagacgaagcgcuaccuccccgccaucguccgggaggccaucaagcgcggccugcggacccugauccucgccccgacccgcgugguggcggccgagauggaggaggcccugcgggggcugcccauccgcuaccagacccccgccauccgcgccgagcacacgggccgggagaucgucgaccucaugugccacgcgaccuucaccaugcgccugcugucccccgugcgggugccgaacuacaaccucaucaucauggacgaggcccacuucaccgaccccgccagcaucgccgcccgcggguacaucagcacgcgggucgagaugggcgaggcggccggcaucuucaugaccgccacgccgcccgggucccgcgacccguucccccagagcaacgcccccaucaucgacgaggagcgggagauccccgagcgcuccuggaacagcggccacgagugggugaccgacuucaaggggaagacggugugguucgucccguccaucaaggccggcaacgacaucgcggccugccugcggaagaacgggaagaaggugauccagcugagccgcaagaccuucgacuccgaguacgugaagacccggaccaacgacugggacuucgucgugacgaccgacaucagcgagaugggcgccaacuucaaggccgagcgcgugaucgacccccggcgcugcaugaagcccgucauccucaccgacggcgaggagcgggugauccuggcggggcccaugccggugacccacuccagcgccgcccagcgccggggccgcaucgggcggaaccccaagaacgagaacgaccaguacaucuacaugggcgagccccuggagaacgacgaggacugcgcccacuggaaggaggccaagaugcuccuggacaacaucaacacgcccgaggggaucaucccguccauguucgagcccgagcgcgagaaggucgacgcgaucgacggcgaguaccgccugcggggcgaggcccgcaagaccuucguggaccucaugcggcgcggggaccugcccguguggcuggccuacaaggucgccgccgagggcaucaacuacgcggaccggcgcuggugcuucgacgggaucaagaacaaccagauccucgaggagaacguggaggucgagaucuggaccaaggagggcgagcggaagaagcugaagccgcgcuggcuggacgcccggaucuacagcgacccccucgcccugaaggaguucaaggaguucgccgccgggcgcaagucccugacccucaaccugaucacggagaugggccggcugcccaccuucaugacccagaagacccgcgacgcgcucgacaaccuggccgugcugcacacggccgaggccggcgggcgggcguacaaccacgcccucagcgagcugcccgagacccuggagacccuccugcugcucacccugcuggccacggugaccggcgggaucuuccucuuccugauguccggccgcggcaucgggaagaugacccugggcaugugcugcaucaucaccgccagcauccuccugugguacgcccagauccagccgcacuggaucgcggccuccaucauccuggaguucuuccucaucguccugcugauccccgagcccgagaagcagcggacgccccaggacaaccagcucacguacguggugaucgccauccugaccgucguggccgccaccauggcgaacgagaugggguuccuggagaagaccaagaaggacuucggccucgggagcaucgccacgcagcagccggaguccaacauccuggacaucgaccugcgccccgccagcgccuggacccucuacgccguggcgaccaccuucgucacgcccaugcugcggcacagcaucgagaacuccagcgugaacgugucccugaccgccaucgccaaccaggccaccguccucaugggccugggcaagggguggccccugagcaagauggacaucggcgugccgcuccuggccaucgggugcuacucccaggugaaccccaucacccugacggcggcccuccugcugcucgucgcccacuacgccaucaucggccccgggcugcaggcgaaggccacccgcgaggcccagaagcgggccgccgcgggcaucaugaagaaccccaccguggacggcaucaccgugaucgaccuggacccgauccccuacgaccccaaguucgagaagcagcucgggcaggucaugcugcugauccucugcgugacccaggugcugaugaugcgcaccaccugggcccugugcgaggcccucacccuggccacgggccccaucagcacccugugggaggggaacccgggccgguucuggaacaccaccaucgccgucuccauggcgaacaucuuccgcgggagcuaccucgccggcgccggccugcuguucuccaucaugaagaacacgaccaacacccgccgggggaccggcaacaucggggagacgcucggcgagaaguggaagucccgccugaacgcccugggcaaguccgaguuccagaucuacaagaaguccgggauccaggagguggaccggacccucgccaaggagggcaucaagcgcggggagaccgaccaccacgcggugucccggggcagcgccaagcugcgcugguucgucgagcggaacauggugacccccgaggggaagguggucgaccugggcugcggccgcgggggcugguccuacuacugcgggggccuccggaacgugcgcgaggugaaggggcugacgaagggcggccccgggcacgaggagcccaucccgaugagcaccuacggcuggaaccugguccggcuccaguccgggguggacguguucuucaucccgcccgagaagugcgacacccugcugugcgacaucggcgagagcucccccaacccgaccgucgaggccgggcgcacgcuccgggugcugaaccugguggagaacuggcucaacaacaacacccaguucugcaucaagguccugaaccccuacaugcccagcgugaucgagaagauggaggcccugcagcgcaaguacggcggcgcgcuggugcggaacccgcucagccgcaacuccacccacgagauguacugggucagcaacgccuccgggaacaucgugagcuccgugaacaugaucagccggaugcugaucaaccgcuucaccaugcggcacaagaaggccaccuacgagcccgacgucgaccugggcuccgggacgcgcaacaucggcaucgagagcgagauccccaaccucgacaucaucgggaagcgcaucgagaagaucaagcaggagcacgagaccuccuggcacuacgaccaggaccaccccuacaagaccugggccuaccacggcagcuacgagaccaagcagacgggcuccgccagcuccauggugaacggggugguccggcugcugaccaagccgugggacgugcuccccaccgugacccagauggcgaugacggacaccacccccuucggccagcagcgcgucuucaaggagaagguggacacccggacgcaggagcccaaggaggggaccaagaagcugaugaagaucaccgccgaguggcuguggaaggagcucggcaagaagaagaccccgcgcaugugcacgcgggaggaguucacccgcaaggugcggagcaacgccgcccugggcgccaucuucaccgacgagaacaaguggaaguccgcgcgcgaggccgucgaggacagccgguucugggagcugguggacaaggagcgcaaccuccaccuggaggggaagugcgagaccugcgucuacaacaugaugggcaagcgggagaagaagcugggggaguucggcaaggccaaggggucccgcgccaucugguacauguggcucggcgcccgguuccuggaguucgaggcgcugggcuuccucaacgaggaccacugguucagccgcgagaacucccugagcgggguggagggcgaggggcugcacaagcucggcuacauccugcgggacgugagcaagaaggagggcggcgccauguacgccgacgacacggccggcugggacacccgcaucacccuggaggaccucaagaacgaggagauggucaccaaccacauggagggggagcacaagaagcuggcggaggccaucuucaagcugacguaccagaacaagguggugcggguccagcgccccacgccccggggcaccgugauggacaucaucucccgccgggaccagcgcgggagcggccagguggggaccuacggccucaacacguucaccaacauggaggcccagcugauccgccagauggagggcgagggggucuucaagaacauccagcaccugaccgugaccgaggagguggccguccagaacuggcucgcccgggugggccgcgagcggcugucccgcauggcgaucagcggggacgacugcguggucaagccccuggacgaccgguucgccaacgcccucacggcccugaacgacaugggcaagauccgcaaggacauccagcagugggagccguccaagggcuggaacgacuggacccaggugcccuucugcagccaccacuuccacgagcugaucaugaaggacgggcgggugcucgucgugcccugccgcaaccaggacgagcugaucggccgggcccgcaucucccagggggcgggcuggagccugcgggagaccgccugccucgggaaguccuacgcccagauguggagccugauguacuuccaccgccgggaccugcgccucgccgccaacgcgaucugcuccgccgugcccagccacugggucccgaccucccggacgaccuggagcauccacgccaagcacgaguggaugaccaccgaggacaugcuggccguguggaaccgcguguggauccgggagaaccccuggauggaggacaagacccccgucgaguccugggaggagauccccuaccugggcaagcgcgaggaccaguggugcggcagccucaucgggcugacgucccgggccaccugggcgaagaacauccaggccgccaucaaccaggugcgcagccugaucggcaacgaggaguacaccgacuacaugccgagcaugaagcgcuuccggcgcgaggaggaggaggccggggugcucugguga

SEQ ID NO: 9585 - RNA, 9876 nt, Artificial Sequence
  derived and/or modified CDS sequence (opt1) from DENV-2__EU482677__SS-prME
agcgccgggaugaucaucaugcugauccccaccgugauggccuuccaccucaccacccggaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucgugaccgacaacguccacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggaggucgaggacuacggguucggcguguucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgucaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgucaccgccggccacggccagguggacaacuucagccugggcgugcugggcauggcccucuuccuggaggagaugcugcggacccgcgucgggacgaagcacgcgauccuccugguggccguguccuucgucacccugaucaccggcaacaugagcuucaaggaccucgggcgggugguggucauggugggcgccaccauggccgacgacaucgggaugggcgugacguaccuggcccugcucgcggccuucaagguccgccccaccuucgccgccggccugcugcuccggaagcugaccuccaaggagcugaugaugaccacgaucgggaucgugcuccugagccaguccaccauccccgagaccgugcuggagcucaccgacgcccuggcgcugggcaugaugguccucaagaucgugcgcaacauggagaaguaccagcuggccgucacgaucauggccauccugugcgugccgaacgccgugauccuccagaacgccuggaaggucagcugcaccauccuggcggugguguccgucagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcaugguguccauccuggccagcucccuccugaagaacgacauccccaugaccggcccccuggucgccgggggccuccugaccgugugcuacgugcugaccgggcgcagcgccgaccucgagcuggagcgggccacggacgucaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggugaagaagcagcgggccgggguccucugggacgugcccagcccgccgcccaugggcaaggcggagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcgcuggagcccggcaagaacccccgggccgugcagacgaagcccgggcuguucaagaccuccaccggcaccaucggggccgucagccucgacuucucccccggcacgagcggcucccccaucaucgacaagaaggggaagguggugggccuguacgggaacggcgucgugacccgcagcggcgccuacguguccgccaucgcgcagaccgagaaguccaucgaggacaaccccgagaucgaggacgacaucuuccggaagcgccggcugaccaucauggaccugcaccccggggccggcaagacgaagcgcuaccuccccgccaucguccgggaggccaucaagcgcgggcugcggacccugauccucgcgccgacccgcgugguggccgccgagauggaggaggcccugcggggccugcccauccgcuaccagacccccgccauccgggcggagcacacggggcgcgagaucgucgaccucaugugccacgccaccuucaccaugcgccugcugucccccgugcgggugccgaacuacaaccucaucaucauggacgaggcccacuucaccgaccccgccagcaucgccgcgcgcggcuacaucagcacgcgggucgagaugggcgaggccgccgggaucuucaugaccgccacgccgcccggcucccgcgacccguucccccagagcaacgcccccaucaucgacgaggagcgggagauccccgagcgcuccuggaacagcgggcacgagugggugaccgacuucaagggcaagacggugugguucgucccguccaucaaggcggggaacgacaucgccgccugccugcggaagaacggcaagaaggugauccagcugagccgcaagaccuucgacuccgaguacgugaagaccaagaccaacgacugggacuucgucgugacgaccgacaucagcgagaugggcgccaacuucaaggcggagcgggugaucgacccccgccggugcaugaagcccgucauccucaccgacggggaggagcgcgugauccuggccggccccaugccggugacccacuccagcgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccguccauguucgagcccgagcgggagaaggucgacgccaucgacggcgaguaccgccugcgcggggaggcccgcaagaccuucguggaccucaugcgccggggcgaccugcccguguggcuggccuacaaggucgccgcggaggggaucaacuacgccgaccgccgguggugcuucgacggcaucaagaacaaccagauccucgaggagaacguggaggucgagaucuggaccaaggagggggagcgcaagaagcugaagccgcgguggcuggacgcccgcaucuacagcgacccccucgcccugaaggaguucaaggaguucgccgcgggccggaagucccugacccucaaccugaucacggagaugggccgccugcccaccuucaugacccagaaggcccgggacgcccucgacaaccuggccgugcugcacaccgcggaggccgggggccgcgccuacaaccacgcccucagcgagcugcccgagacgcuggagacccuccugcugcucacccugcuggccaccgugaccggcgggaucuuccucuuccugauguccgggcgggggaucggcaagaugacccuggggaugugcugcaucaucaccgcgagcauccuccugugguacgcccagauccagccgcacuggaucgccgccuccaucauccuggaguucuuccucaucguccugcugauccccgagcccgagaagcagcgcacgccccaggacaaccagcucaccuacguggugaucgccauccugacggucguggcggccaccauggccaacgagaugggcuuccuggagaagaccaagaaggaccucgggcugggcagcaucgccacccagcagccggaguccaacauccuggacaucgaccuccggcccgccagcgcguggacgcuguacgccguggccaccaccuucgucacccccaugcugcgccacagcaucgagaacuccagcgugaacgugucccucacggccaucgccaaccaggcgaccguccugaugggccuggggaagggcuggccccucagcaagauggacaucggggugccgcugcuggccaucggcugcuacucccaggugaaccccaucacccucaccgccgcccugcugcuccuggucgcgcacuacgccaucaucgggcccggccugcaggccaaggccacgcgggaggcccagaagcgcgcggccgccggcaucaugaagaaccccaccguggacgggaucaccgugaucgaccucgacccgauccccuacgaccccaaguucgagaagcagcugggccaggucaugcugcucauccugugcgugacccaggugcugaugaugcggacgaccugggcccucugcgaggcccugacccuggcgaccgggcccaucagcacgcucugggagggcaacccggggcgcuucuggaacaccaccaucgccgucuccauggccaacaucuuccggggcagcuaccuggccggcgccgggcuccucuucuccaucaugaagaacaccacgaacacccgccggggcaccgggaacaucggcgagacccugggcgagaaguggaagucccgccugaacgcgcucgggaaguccgaguuccagacguacaagaaguccggcauccaggagguggaccgcacccuggccaaggaggggaucaagcggggcgagaccgaccaccacgccgugucccgcgggagcgccaagcugcggugguucgucgagcgcaacauggugacccccgagggcaagguggucgaccucggcugcgggcggggcgggugguccuacuacugcggcgggcugaagaacgugcgcgaggugaagggccugacgaagggcgggcccggccacgaggagcccaucccgaugagcaccuacggguggaaccucguccggcugcaguccggcguggacguguucuucaucccgcccgagaagugcgacacccugcucugcgacaucggggagagcucccccaacccgaccgucgaggcgggccgcacgcugcgggugcugaaccucguggagaacuggcugaacaacaacacccaguucugcaucaagguccugaaccccuacaugcccagcgugaucgagaagauggaggcccugcagcgcaaguacggcggggcccucgugcggaacccgcugagccgcaacuccacccacgagauguacugggucagcaacgccuccggcaacaucgugagcuccgugaacaugaucagccggaugcugaucaaccgcuucaccaugcggcacaagaaggccaccuacgagcccgacgucgaccucggguccggcacgcgcaacaucgggaacgagagcgagauccccaaccuggacaucaucggcaagcggaucgagaagaucaagcaggagcacgagaccuccuggcacuacgaccaggaccaccccuacaagaccugggcguaccacggcagcuacgagaccaagcagacgggguccgccagcuccauggugaacggcgugguccgccugcucaccaagccgugggacgugcugcccaccgugacccagauggccaugacggacaccacccccuucgggcagcagcgggucuucaaggagaagguggacacccgcacgcaggagcccaaggagggcaccaagaagcugaugaagaucaccgccgaguggcucuggaaggagcugggcaagaagaagaccccgcgcaugugcacgcgggaggaguucacccgcaaggugcggagcaacgccgcgcugggggccaucuucaccgacgagaacaaguggaaguccgcccgcgaggccgucgaggacagccgguucugggagcucguggacaaggagcgcaaccugcaccuggagggcaagugcgagaccugcgucuacaacaugauggggaagcgggagaagaagcucggcgaguucgggaaggccaagggcucccgcgcgaucugguacauguggcugggcgcccgguuccuggaguucgaggcccucggguuccugaacgaggaccacugguucagccgcgagaacucccugagcggcguggagggggagggccuccacaagcugggguacauccugcgggacgugagcaagaaggagggcggcgccauguacgcggacgacacggccgggugggacacccgcaucacccucgaggaccugaagaacgaggagauggucaccaaccacauggagggcgagcacaagaagcuggccgaggccaucuucaagcucacguaccagaacaagguggugcggguccagcgccccacgccccgggggaccgugauggacaucaucucccgccgggaccagcgcggcagcggccagguggggaccuacggccugaacacguucaccaacauggaggcccagcugauccggcagauggagggggagggcgucuucaagaacauccagcaccucaccgugaccgaggagguggcgguccagaacuggcuggcccgcguggggcgggagcgccugucccgcauggccaucagcggcgacgacugcguggucaagccccucgacgaccgguucgccaacgcccugacggcgcugaacgacaugggcaagauccgcaaggacauccagcagugggagccguccaagggguggaacgacuggacccaggugcccuucugcagccaccacuuccacgagcucaucaugaaggacggccgggugcuggucgugcccugccgcaaccaggacgagcugaucgggcgggcccgcaucucccagggcgccggguggagccuccgggagaccgccugccugggcaaguccuacgcccagauguggagccugauguacuuccaccgccgggaccuccgccuggcggccaacgccaucugcuccgccgugcccagccacugggucccgaccucccggacgaccuggagcauccacgccaagcacgaguggaugaccaccgaggacaugcugaccguguggaaccgcguguggauccgggagaaccccuggauggaggacaagacgcccgucgaguccugggaggagauccccuaccucggcaagcgcgaggaccaguggugcgggagccugaucggccugaccucccgggcgaccugggccaagaacauccagguggccaucaaccaggugcgcagccucaucgggaacgaggaguacaccgacuacaugccgagcaugaagcgguuccgccgggaggaggaggaggccggcguccugugguga

SEQ ID NO: 9586 - RNA, 9876 nt, Artificial Sequence
  derived and/or modified CDS sequence (opt1) from DENV-2__EU482678__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacgagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacgaccgagugcccgaacaccaaccgcgcguggaacagccuggagguggaggacuacggguucggcgucuucaccacgaacaucuggcucaagcugaaggagaagcaggacgccuucugcgacuccaagcugaugagcgccgccaucaaggacaaccgggccgugcacgcggacaugggguacuggaucgaguccgcccucaacgacaccuggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgccggccccuggcaccuggggaagcuggagauggacuucgacuucugcgacggcaccacggugaucgucaccgaggacugcgggaaccggggccccucccuccgcaccaccacggcgagcggcaagcugaucaccgaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacgcgcguggggaccaagcacgccauccuccuggucgcgguguccuucgugacccugaucaccggcaacaugagcuucaaggaccucgggcgggucguggugauggucggcgccacgauggccgacgacaucgggaugggcgugaccuaccuggcccugcucgccgcguucaaggugcgccccaccuucgccgccggccugcugcuccggaagcugaccuccaaggagcugaugaugacgaccaucgggaucguccuccugagccaguccaccauccccgagaccgugcuggagcucacggacgcccuggcccugggcaugauggugcucaagaucguccgcaacauggagaaguaccagcuggcggugaccaucauggccauccugugcgucccgaacgccgugauccuccagaacgccuggaaggugagcugcaccauccuggccgucguguccgugagcccccugcuccugaccuccagccagcagaagacggacuggaucccccuggcgcucgccaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacaccgggcacgagugggucacggacuucaagggcaagaccgugugguucgugccguccaucaaggcggggaacgacaucgccgccugccugcggaagaacggcaagaaggucauccagcugagccgcaagaccuucgacuccgaguacgugaagacccggacgaacgacugggacuucguggucaccaccgacaucagcgagaugggcgccaacuucaaggcggagcgcgugaucgacccccggcgcugcaugaagcccgugauccucaccgacggggaggagcgggucauccuggccggccccaugccggugacgcacuccagcgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacagcgacccccucgcccugaaggaguucaaggaguucgccgcgggccgcaagucccugacgcucaaccugaucaccgagaugggccggcugcccaccuucaugacccagaagacgcgcgacgcccucgacaaccuggccguccugcacaccgccgaggccggcgggcgggccuacaaccacgcccucagcgagcugcccgagacccuggagacccuccugcugcucacgcugcuggccaccgugaccgggggcaucuuccucuuccugauguccggccgcgggaucggcaagaugacccuggggaugugcugcaucaucaccgccagcauccuccugugguacgcgcagauccagccgcacuggaucgccgccuccaucauccuggaguucuuccucaucgugcugcugauccccgagcccgagaagcagcggacgccccaggacaaccagcucaccuacgucgugaucgccauccugaccguggucgccgcgaccauggccaacgagaugggcuuccuggagaagacgaagaaggaccucgggcugggcagcaucgccacccagcagccggaguccaacauccuggacaucgaccuccgccccgccagcgccuggacccuguacgcgguggccaccacguucgugacccccaugcugcggcacuccaucgagaacagcagcgucaacgugucccucaccgccaucgccaaccaggccaccgugcugaugggccuggggaagggcuggccccucagcaagauggacaucggggucccgcugcuggcgaucggcugcuacucccaggugaaccccaucacgcucaccgccgcccugcugcuccugguggcccacuacgcgaucaucgggcccggccugcaggccaaggccacccgcgaggcccagaagcgggccgcggccggcaucaugaagaaccccaccgucgacgggaucacggugaucgaccucgacccgauccccuacgaccccaaguucgagaagcagcugggccaggugaugcugcucauccugugcgucacccaggugcugaugaugcgcaccaccugggcccucugcgaggcccugacgcuggccaccgggcccaucagcacccucugggagggcaacccggggcgguucuggaacaccacgaucgcgguguccauggccaacaucuuccgcggcagcuaccuggccggcgccgggcuccucuucuccaucaugaagaacaccaccaacacccggcgcggcacggggaacaucggcgagacccugggcgagaaguggaagucccgccugaacgcccucgggaaguccgaguuccagaucuacaagaaguccggcauccaggaggucgaccggacccuggcgaaggaggggaucaagcgcggcgagaccgaccaccacgccgugucccgggggagcgccaagcugcgcugguucguggagcggaacauggucacgcccgagggcaaggugguggaccucggcugcgggcgcggcgggugguccuacuacugcggcgggcugaagaacguccgggaggugaagggccugaccaagggcgggcccggccacgaggagcccaucccgaugagcaccuacggguggaaccucgugcgccugcaguccggcgucgacguguucuucaucccgcccgagaagugcgacacccugcucugcgacaucggggagagcucccccaacccgacgguggaggccggccggacccugcgcguccugaaccucguggagaacuggcugaacaacaacacccaguucugcaucaaggugcugaaccccuacaugcccagcgucaucgagaagauggaggcgcugcagcggaaguacggcggggcccucgugcgcaacccgcugucccggaacagcacccacgagauguacugggugagcaacgccuccggcaacaucgucagcuccgugaacaugaucagccgcaugcugaucaaccgguucaccaugcgccacaagaaggccacguacgagcccgacguggaccucggguccggcacccggaacaucgggaucgagagcgagauccccaaccuggacaucaucggcaagcgcaucgagaagaucaagcaggagcacgagaccuccuggcacuacgaccaggaccaccccuacaagaccugggccuaccacggcagcuacgagacgaagcagaccggguccgcgagcuccauggucaacggcguggugcggcugcucaccaagccgugggacguccugcccaccgugacgcagauggccaugaccgacaccacccccuucgggcagcagcgcguguucaaggagaaggucgacacgcgcacccaggagcccaaggagggcaccaagaagcugaugaagaucaccgccgaguggcucuggaaggagcugggcaagaagaagacgccgcggaugugcacccgcgaggaguucacccggaaggugcgcagcaacgccgcccugggggcgaucuucaccgacgagaacaaguggaaguccgcccgggaggccguggaggacagccgcuucugggagcucgucgacaaggagcggaaccugcaccuggagggcaagugcgagacgugcguguacaacaugauggggaagcgcgagaagaagcucggcgaguucgggaaggccaagggcucccgggccaucugguacauguggcugggcgcgcgcuuccuggaguucgaggcccucggguuccugaacgaggaccacugguucagccgggagaacucccugagcggcgucgagggggagggccuccacaagcugggguacauccugcgcgacguguccaagaaggagggcggcgccauguacgccgacgacaccgcggggugggacacccggaucacccucgaggaccugaagaacgaggagauggugacgaaccacaugaagggcgagcacaagaagcuggccgaggccaucuucaagcucaccuaccagaacaaggucgugcgcgugcagcggcccacgccccgggggaccgucauggacaucaucagccggcgcgaccagcggggcagcggccagguggggacguacggccugaacaccuucaccaacauggaggcccagcugauccgccagauggagggggagggcguguucaagaacauccagcaccucaccgucacggaggagguggccgugcagaacuggcuggcgcgggucgggcgcgagcgccugucccggauggccaucagcggcgacgacugcguggugaagccccucgacgaccgcuucgccaacgcccugaccgcccugaacgacaugggcaagauccggaaggacauccagcagugggagccguccaagggguggaacgacuggacccagguccccuucugcagccaccacuuccacgagcucaucaugaaggacggccgcgugcuggugguccccugccggaaccaggacgagcugaucgggcgcgcgcggaucucccagggcgccggguggagccuccgcgagaccgccugccugggcaaguccuacgcccagauguggagccugauguacuuccaccggcgcgaccuccggcuggccgcgaacgccaucugcuccgccgugcccagccacugggugccgacgucccgcaccaccuggagcauccacgccaagcacgaguggaugaccaccgaggacaugcugacggucuggaaccggguguggauccgcgagaaccccuggauggaggacaagacccccguggaguccugggaggagauccccuaccucggcaagcgggaggaccaguggugcgggagccugaucggccugaccucccgcgccaccugggcgaagaacauccaggccgccaucaaccagguccggagccucaucgggaacgaggaguacacggacuacaugccguccaugaagcgcuuccggcgcgaggaggaggaggccggcgugcugugguga

SEQ ID NO: 9587 - RNA, 9876 nt, Artificial Sequence
  derived and/or modified CDS sequence (opt1) from DENV-2__EU482679__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgagucccacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccauccgggucccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggucugguucgugccgagcaucaaggcggggaacgacaucgccgccugccugcggaagaacggcaagaaggugauccagcugucccgcaagaccuucgacagcgaguacgucaagacccggaccaacgacugggacuucguggugacgaccgacaucuccgagaugggcgccaacuucaaggcggagcgcgucaucgacccccggcgcugcaugaagcccgugauccucaccgacggggaggagcgggugauccuggccggccccaugccggucacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucguggaccucaugcggcgcggcgaccugcccgucuggcuggccuacaagguggccgcggaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccgugcugcacacggccgaggccggcgggcgggccuacaaccacgcccucuccgagcugcccgagacccuggagacccuccugcugcucacccugcuggccacggucaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacguggucaucgccauccugaccgugguggccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcggucgccaccaccuucgugacgcccaugcugcggcacagcaucgagaacagcuccgugaacgucagccucaccgccaucgccaaccaggccaccgugcugaugggccuggggaagggcuggccccucuccaagauggacaucggggugccgcugcuggcgaucggcugcuacagccaggucaaccccaucacccucacggccgcccugcugcuccugguggcccacuacgcgaucaucgggcccggccugcaggccaaggccacccgcgaggcccagaagcgggccgcggccggcaucaugaagaaccccaccguggacgggaucaccgucaucgaccucgacccgauccccuacgaccccaaguucgagaagcagcugggccaggugaugcugcucauccugugcgugacgcagguccugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacaugggcgagacgcugggcgagaaguggaagucccgccugaacgcccucgggaaguccgaguuccagaucuacaagaaguccggcauccaggagguggaccggacccuggcgaaggaggggaucaagcgcggcgagaccgaccaccacgccgucagccggggguccgccaagcugcgcugguucguggagcggaacauggugacccccgagggcaaggucguggaccucggcugcgggcgcggcggguggagcuacuacugcggcgggcugaagaacgugcgggaggucaagggccugacgaagggcgggcccggccacgaggagcccaucccgauguccaccuacggguggaaccucgugcgccugcagagcggcguggacgucuucuucaucccgcccgagaagugcgacacccugcucugcgacaucggggaguccagccccaacccgaccguggaggccggccggacgcugcgcgugcugaaccucgucgagaacuggcugaacaacaacacccaguucugcaucaaggugcugaaccccuacaugcccuccgugaucgagaagauggaggcgcugcagcggaaguacggcggggcccucguccgcaacccgcugagccggaacagcacccacgagauguacuggguguccaacgccagcggcaacaucguguccagcgucaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggugaacggcgucgugcggcugcucaccaagccgugggacgugcugcccaccgucacccagauggccaugacggacaccacccccuucgggcagcagcgcguguucaaggagaagguggacacccgcacgcaggagcccaaggagggcaccaagaagcugaugaagaucaccgccgaguggcucuggaaggagcugggcaagaagaagaccccgcggauggggacgcgcgaggaguucacccggaagguccgcuccaacgccgcccugggcgcgaucuucaccgacgagaacaaguggaaguccgcccgggaggccguggaggacucccgcuucugggagcucguggacaaggagcggaaccugcaccuggaggggaagugcgagaccugcgucuacaacaugaugggcaagcgcgagaagaagcucggggaguucggcaaggccaagggcagccgggccaucugguacauguggcugggggcgcgcuuccuggaguucgaggcccucggcuuccugaacgaggaccacugguucucccgggagaacagccuguccgggguggagggcgaggggcuccacaagcugggcuacauccugcgcgacgucagcaagaaggagggcggggccauguacgccgacgacacggcgggcugggacacccggaucacccucgaggaccugaagaacgaggagauggugaccaaccacauggagggggagcacaagaagcuggccgaggccaucuucaagcucacguaccagaacaaggugguccgcgugcagcggcccacgccccggggcaccgugauggacaucaucagccggcgcgaccagcggggguccggccaggucggcaccuacgggcugaacacguucaccaacauggaggcccagcugauccgccagauggagggcgaggggguguucaagaacauccagcaccucaccgugaccgaggaggucgccgugcagaacuggcuggcgcgggugggccgcgagcgccugagccggauggccaucuccggcgacgacugcgucgugaagccccucgacgaccgcuucgccaacgcccugacggcccugaacgacauggggaagauccggaaggacauccagcagugggagccgagcaagggcuggaacgacuggacccaggugcccuucugcucccaccacuuccacgagcucaucaugaaggacgggcgcguccugguggugcccugccggaaccaggacgagcugaucggccgcgcgcggaucagccagggggccggcuggucccuccgcgagaccgccugccugggcaagagcuacgcccagauguggucccugauguacuuccaccggcgcgaccuccggcuggccgcgaacgccaucugcagcgccguccccucccacugggugccgaccagccgcacgaccugguccauccacgccaagcacgaguggaugaccaccgaggacaugcugaccguguggaaccgggucuggauccgcgagaaccccuggauggaggacaagacgcccguggagagcugggaggagauccccuaccucgggaagcgggaggaccaguggugcggcucccugaucgggcugaccagccgcgccaccugggcgaagaacauccaggccgccaucaaccaggugcggucccucaucggcaacgaggaguacaccgacuacaugccgagcaugaagcgcuuccggcgcgaggaggaggaggccgggguccugugguga

SEQ ID NO: 9588 - RNA, 9876 nt, Artificial Sequence
  derived and/or modified CDS sequence (opt1) from DENV-2__EU482774__SS-prME
agcgcggggaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagaucuucaucggggugaucaucaccuggaucggcaugaacucccggagcaccucccugagcgucucccuggugcugguggggaucgucacgcucuaccugggcgugauggugcaggccgacagcgggugcgucguguccuggaagaacaaggagcugaagugcggcagcggcaucuucaucaccgacaacgugcacaccuggaccgagcaguacaaguuccagcccgagagccccuccaagcucgccagcgcgauccagaaggcccaggaggaggggaucugcggcauccgcuccgucacgcggcuggagaaccugauguggaagcagaucacccccgagcucaaccacauccuggccgagaacgaggugaagcugaccaucaugaccggggacaucaagggcaucaugcaggccgggaagcgcagccuccggccgcagcccacggagcugaaguacuccuggaagaccuggggcaaggccaagaugcugagcaccgagucccacaaccagaccuuccucaucgacggccccgagacggcggagugcccgaacaccaaccgcgccuggaacagccuggagguggaggacuacggguucggcgucuucaccaccaacaucuggcugaagcucaaggagaagcaggacgccuucugcgacuccaagcugaugagcgccgccaucaaggacaaccgggcggugcacgccgacaugggguacuggaucgaguccgcccugaacgacacguggaagaucgagaaggccagcuucaucgaggugaagaacugccacuggcccaagucccacacccucuggagcaacggcguccuggaguccgagaugaucauccccaagaaccuggccggccccgugagccagcacaacuaccgcccgggguaccacacccagaucgcgggccccuggcaccucgggaagcuggagauggacuucgacuucugcgacggcaccaccgugaucgucacggaggacugcgggaaccggggccccucccugcgcaccaccaccgccagcggcaagcucaucacggaguggugcugccggagcugcacccugcccccgcugcgcuaccgcggggaggacggcugcugguacgggauggagauccgcccccucaaggagaaggaggagaaccuggugaacucccuggugaccgccggccacgggcaggucgacaacuucagccucggcgugcugggcauggcccuguuccucgaggagaugcugcggacccgcguggggacgaagcacgcgauccugcucgucgccguguccuucgugacccugaucaccggcaacaugagcuucaaggaccuggggcgggucguggugauggucggcgccaccauggccgacgacaucgggaugggcgugacguaccucgcccugcuggcggccuucaaggugcgccccaccuucgccgccggccuccugcugcggaagcucaccuccaaggagcugaugaugaccacgaucgggaucguccugcucagccaguccaccauccccgagaccgugcuggagcugaccgacgcccucgcgcugggcaugauggugcugaagaucguccgcaacauggagaaguaccagcucgccgugacgaucauggccauccugugcgucccgaacgccguggugcugcagaacgccuggaaggucagcugcaccauccucgcggugguguccgucagcccccugcugcucaccuccagccagcagaagaccgacuggaucccccuggcccugacgaucaaggggcucaaccccaccgccaucuuccugaccacccugucccgcacgaacaagaagcggagcuggccgcucaacgaggccaucauggcggugggcaugguguccauccuggccagcucccugcucaagaacgacauccccaugaccggcccccuggucgccgggggccugcucaccgugugcuacgugcugaccgggcgcagcgccgaccuggagcucgagcgggccacggacgucaagugggaggaccaggcggagaucuccggcagcagccccauccuguccaucaccaucagcgaggacggguccaugagcaucaagaacgaggaggaggagcagacccugaccauccucauccgcacgggccugcuggugaucuccggccucuucccgaucagcauccccaucaccgccgccgccugguaccugugggaggugaagaagcagcgggccgggguccugugggacgugcccagcccgccgcccaugggcaaggcggagcucgaggacggggccuaccgcaucaagcagaagggcauccugggguacagccagaucggcgccggcguguacaaggaggggaccuuccacaccauguggcacgucacccggggcgccgugcugaugcacaaggggaagcgcaucgagcccuccugggccgacgugaagaaggaccucaucagcuacggcgggggcuggaagcuggagggcgaguggaaggagggggaggagguccaggugcuggcgcucgagcccggcaagaacccccgggccgugcagacgaagcccgggcuguucaagaccaacaccggcaccaucggggccgucucccuggacuucagccccggcacguccggcagccccaucaucgacaagaaggggaagguggugggccucuacgggaacggcgucgugacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccugcccgccaucguccgggaggccaucaagcgcgggcuccggacccugauccuggcgccgacccgcgugguggccgccgagauggaggaggcccuccggggccugcccauccgcuaccagacccccgccaucaaggcggagcacacggggcgggagaucgucgaccugaugugccacgccaccuucaccaugcgccuccugagccccgugcgcgugccgaacuacaaccugaucaucauggacgaggcccacuucaccgaccccgccuccaucgccgcgcggggcuacaucagcacgcgcgucgagaugggcgaggccgccgggaucuucaugaccgccacgccgcccggcagccgggacccguucccccaguccaacgcccccaucaucgacgaggagcgcgagauccccgagcggagcuggaacuccgggcacgagugggugaccgacuucaagggcaagacggugugguucgucccgagcaucaaggcggggaacgacaucgccgccugccuccgcaagaacggcaagaaggugauccagcugucccggaagaccuucgacagcgaguacgugaagacccgcaccaacgacugggacuucgucgugacgaccgacaucuccgagaugggcgccaacuucaaggcggagcgggugaucgacccccgccggugcaugaagcccgucauccugaccgacggggaggagcgcgugauccucgccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcugcucgacaacaucaacacgcccgagggcaucaucccgagcauguucgagcccgagcgggagaaggucgacgccaucgacggcgaguaccgccugcgcggggaggcccgcaagaccuucguggaccugaugcgccggggcgaccuccccguguggcuggccuacaaggucgccgcggaggggaucaacuacgccgaccgccgguggugcuucgacggcaucaagaacaaccagauccuggaggagaacguggaggucgagaucuggaccaaggagggggagcgcaagaagcucaagccgcgguggcuggacgcccgcaucuacuccgacccccuggcccucaaggaguucaaggaguucgccgcgggccggaagucccugacccugaaccucaucacggagaugggccgccugcccaccuucaugacccagaagacccgggacgcccuggacaaccucgccgugcugcacacggccgaggccggcgggcgcgccuacaaccacgcccuguccgagcuccccgagacccuggagacccugcuccugcugacccuccuggccacggugaccgggggcaucuuccuguuccucaugagcggccgggggaucggcaagaugacccuggggaugugcugcaucaucaccgccuccauccugcucugguacgcgcagauccagccgcacuggaucgccgccagcaucauccuggaguucuuccugaucguccuccugauccccgagcccgagaagcagcgcacgccccaggacaaccagcugacguacguggugaucgccauccucaccgucguggccgcgaccauggccaacgagaugggcuuccuggagaagaccaagaaggaccuggggcucggcuccaucgccacgcagcagccggagagcaacauccuggacaucgaccugcggcccgccuccgccuggacccucuacgcgguggccaccaccuucgucacgcccaugcugcgccacagcaucgagaacagcuccgugaacgugagccugaccgccaucgccaaccaggccaccguccucaugggccuggggaagggcuggccccuguccaagauggacaucggggugccgcuccuggcgaucggcugcuacagccaggugaaccccaucacccugacggccgcccuccugcugcucgucgcccacuacgcgaucaucgggcccggccugcaggccaaggccacccgggaggcccagaagcgcgccgcggccggcaucaugaagaaccccaccguggacgggaucaccgugaucgaccuggacccgauccccuacgaccccaaguucgagaagcagcucggccaggucaugcugcugauccucugcgugacccaggugcugaugaugcggaccaccugggcccugugcgaggcccucacccuggccacggggcccaucuccacccugugggagggcaacccggggcgcuucuggaacaccaccaucgcggucagcauggccaacaucuuccggggcuccuaccucgccggcgccgggcugcuguucagcaucaugaagaacacgaccaacacccgccggggcaccgggaacaucggcgagacgcucggcgagaaguggaagucccgccugaacgcccugggcaagagcgaguuccagaucuacaagaaguccggcauccaggagguggaccgcacccucgcgaaggaggggaucaagcggggcgagaccgaccaccacgccgugagccgcggguccgccaagcugcggugguucgucgagcgcaacauggugacccccgagggcaagguggucgaccugggcugcgggcggggcggguggagcuacuacugcggcgggcucaagaacgugcgcgaggugaagggccugacgaagggcgggcccggccacgaggagcccaucccgauguccaccuacggguggaaccugguccggcuccagagcggcguggacguguucuucaucccgcccgagaagugcgacacccugcugugcgacaucggggaguccagccccaacccgaccgucgaggccggccgcacgcuccgggugcugaaccugguggagaacuggcucaacaacaacacccaguucugcaucaagguccugaaccccuacaugcccuccgugaucgagaagauggaggcgcugcagcgcaaguacggcggggcccuggugcggaacccgcucagccgcaacagcacccacgagauguacugggucuccaacgccagcggcaacaucguguccagcgugaacaugaucucccggaugcugaucaaccgcuucaccaugcggcacaagaaggccaccuacgagcccgacgucgaccuggggagcggcacgcgcaacaucgggaucgaguccgagauccccaaccucgacaucaucggcaagcggaucgagaagaucaagcaggagcacgagaccagcuggcacuacgaccaggaccaccccuacaagaccugggccuaccacggcuccuacgagaccaagcagacggggagcgcguccagcauggugaacggcgugguccgccugcugaccaagccgugggacgugcuccccaccgugacccagauggccaugacggacaccacccccuucgggcagcagcgggucuucaaggagaagguggacacccgcacgcaggagcccaaggagggcaccaagaagcugaugaagaucaccgccaaguggcuguggaaggagcucggcaagaagaagaccccgcgcaugugcacgcgggaggaguucacccgcaaggugcgguccaacgccgcccugggggcgaucuucaccgacgagaacaaguggaaguccgcccgcgaggccgucgaggacucccgguucugggagcugguggacaaggagcgcaaccuccaccuggagggcaagugcgagaccugcgucuacaacaugauggggaagcgggagaagaagcugggcgaguucgggaaggccaagggcagccgcgccaucugguacauguggcucggcgcgcgguuccuggaguucgaggcccugggguuccucaacgaggaccacugguucucccgcgagaacagccuguccggcguggagggggagggccugcacaagcucggguacauccugcgggacgugagcaagaaggagggcggcgccauguacgccgacgacacggcggggugggacacccgcaucacccuggaggaccucaagaacgaggagauggucaccaaccacauggagggcgagcacaagaagcuggccgaggccaucuucaagcugacguaccagaacaagguggugcggguccagcgccccacgccccgggggaccgugauggacaucaucagccgccgggaccagcgcggcuccggccagguggggaccuacggccucaacacguucaccaacauggaggcccagcugauccggcagauggagggggagggcgucuucaagaacauccagcaccugaccgugaccgaggagguggccguccagaacuggcucgcgcgcguggggcgggagcgccugagccgcauggccaucuccggcgacgacugcguggucaagccccuggacgaccgguucgccaacgcccucacggcccugaacgacaugggcaagauccgcaaggacauccagcagugggagccgagcaagggguggaacgacuggacccaggugcccuucugcucccaccacuuccacgagcugaucaugaaggacggccgggugcucgucgugcccugccgcaaccaggacgagcugaucgggcgggcgcgcaucagccagggcgccggguggucccugcgggagaccgccugccucggcaagagcuacgcccagauguggucccugauguacuuccaccgccgggaccugcgccucgccgcgaacgccaucugcagcgccgugcccucccacugggucccgaccagccggacgaccugguccauccacgccaagcacgaguggaugaccaccgaggacaugcugaccguguggaaccgcguguggauccgggagaaccccuggauggaggacaagacgcccgucgagagcugggaggagauccccuaccugggcaagcgcgaggaccaguggugcgggucccucaucggccugaccagccgggccaccugggcgaagaacauccaggccgccaucaaccaggugcgcucccugaucgggaacgaggaguacaccgacuacaugccgagcaugaagcgguuccgccgggaggaggaggaggccggcgugcucugguga

SEQ ID NO: 9589 - RNA, 9876 nt, Artificial Sequence
  derived and/or modified CDS sequence (opt1) from DENV-2__EU482775__SS-prME
agcgcggggaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacauccgcggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggccaucauggcggucggcaugguguccauccuggccagcucccuccugaagaacgacauccccaugaccggcccccugguggccgggggccuccugaccgucugcuacgugcugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgucaucuccggccuguucccgaucagcauccccaucaccgccgccgccugguaccugugggaggugaagaagcagcgcgccggggugcucugggacguccccagcccgccgcccaugggcaaggcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugcgcaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgcgcggagcacacggggcgggagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccgccugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccgccggggcaccgggaacaucggcgagacgcugggcgagaaguggaagucccgccugaacgcccucgggaaguccgaguuccagaucuacaagaaguccggcauccaggaggucgaccggacccuggcgaaggaggggaucaagcgcggcgagaccgaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugacgaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgaccguggaggccggccggacgcugcgcguccugaaccucguggagaacuggcugaacaacaacacccaguucugcaucaaggugcugaaccccuacaugcccuccgucaucgagaagauggaggcgcugcagcggaaguacggcggggcccucgugcgcaacccgcugagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggucaacggcguggugcgccugcucaccaagccgugggacguccugcccaccgugacccagauggccaugacggacaccacccccuucgggcagcagcggguguucaaggagaaggucgacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggcgaucuucaccgacgagaacaaguggaaguccgcccgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcgucgagggggagggccuccacaagcugggguacauccugcgcgacgugagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggucgugcgcgugcagcggcccacgccccgggggaccgucauggacaucaucagccggcgcgaccagcggggcuccggccaggugggcaccuacggccugaacacguucaccaacauggaggcccagcugauccgccagauggagggggagggcguguucaagaacauccagcaccucaccgucaccgaggagguggccgugcacaacuggcuggcgcgcgucgggcgggagcgccugagccggauggccaucuccggcgacgacugcguggugaagccccucgacgaccgcuucgccaacgcccugacggcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccgugcccucccacugggugccgaccagccgcacgaccugguccauccacgccaagcacgaguggaugaccaccgaggacaugcugaccgucuggaaccggguguggauccgcgagaaccccuggauggaggacaagacgcccguggagagcugggaggagauccccuaccucggcaagcgggaggaccaguggugcgggucccugaucggccugaccagccgcgccaccugggcgaagaacauccaggccgccaucaaccagguccggucccucaucgggaacgaggaguacaccgacuacaugccgagcaugaagcgcuuccgccgggaggaggaggaggccggcgugcugugguga

SEQ ID NO: 9590 - RNA, 9876 nt, Artificial Sequence
  derived and/or modified CDS sequence (opt1) from DENV-2__EU482776__SS-prME
agcgccgggaugaucaucaugcugauccccaccgugauggccuuccaccucaccacccgcaacggggagccccacaugaucguggggauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacgcggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacauccgcggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuacaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggcgagcugcaccauccuggccguggucuccgugagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggcgaucauggccgugggcauggucuccauccuggccagcucccuccugaagaacgacauccccaugaccggcccccugguggccgggggccuccugaccgugugcuacguccugaccgggcggagcgccgaccucgagcuggagcgcgcgacggacgugaagugggaggaccaggccgagaucuccggcagcagccccauccuguccaucaccaucagcgaggacggguccaugagcaucaagaacgaggaggaggagcagacccucaccauccugauccggacgggccugcucgugaucuccggccuguucccgaucagcauccccaucaccgccgccgccugguaccugugggaggucaagaagcagcgcgcgggggugcucugggacgugcccagcccgccgcccaugggcaaggccgagcuggaggacggggccuaccggaucaagcagaagggcauccugggguacagccagaucggcgccggcgucuacaaggaggggaccuuccacaccauguggcacgugacccgcggcgccgugcucaugcacaaggggaagcggaucgagcccuccugggcggacgucaagaaggaccugaucagcuacggcgggggcuggaagcuggagggcgaguggaaggagggggaggagguccaggugcucgcccuggagcccggcaagaacccccgcgccguccagacgaagcccgggcuguucaagaccaacaccggcaccaucggggccgugucccucgacuucagccccggcacguccggcagccccaucaucgacaagaaggggaagguggucggccuguacgggaacggcguggugacccgguccggcgccuacgucagcgcgaucgcccagaccgagaaguccaucgaggacaaccccgagaucgaggacgacaucuuccgcaagcggcgccugaccaucauggaccugcaccccggggccggcaagacgaagcgguaccuccccgccaucgugcgcgaggcgaucaagcgggggcugcgcacccugauccucgccccgacccggguggucgccgccgagauggaggaggcccugcgcggccugcccauccgguaccagacccccgcgauccgcgccgagcacacggggcgcgagaucguggaccucaugugccacgccaccuucaccaugcggcugcugagccccgugcgcgucccgaacuacaaccucaucaucauggacgaggcccacuucaccgaccccgccuccaucgcggcccggggcuacaucagcacgcgcguggagaugggcgaggccgccgggaucuucaugaccgccacgccgcccggcagccgggacccguucccccaguccaacgcgcccaucaucgacgaggagcgcgagauccccgagcggagcuggaacuccgggcacgagugggugaccgacuucaagggcaagacggucugguucgugccgagcaucaaggccgggaacgacaucgccgccugccugcgcaagaacggcaagaaggugauccagcugucccggaagaccuucgacagcgaguacgucaagacccgcaccaacgacugggacuucguggugacgaccgacaucuccgagaugggcgcgaacuucaaggccgagcgggucaucgacccccgccggugcaugaagcccgugauccucaccgacggggaggagcgcgugauccuggccggccccaugccggucacccacagcuccgccgcccagcggcgcgggcggaucggccgcaaccccaagaacgagaacgaccaguacaucuacaugggggagccccuggagaacgacgaggacugcgcgcacuggaaggaggccaagaugcuccuggacaacaucaacacgcccgagggcaucaucccgagcauguucgagcccgagcgggagaagguggacgccaucgacggcgaguaccgccugcgcggggaggcccggaagaccuucguggaccucaugcgccggggcgaccugcccgucuggcuggccuacaagguggcggccgaggggaucaacuacgccgaccgccgguggugcuucgacggcaucaagaacaaccagauccucgaggagaacauggagguggagaucuggaccaaggagggggagcgcaagaagcugaagccgcgguggcuggacgcccgcaucuacuccgacccccucgcccugaaggaguucaaggaguucgcggccggccggaagucccugacccucaaccugaucacggagaugggccgccugcccaccuucaugacccagaagacccgggacgcccucgacaaccuggccguccugcacacggcggaggccgggggccgcgccuacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgcguccauccuccugugguacgcccagauccagccgcacuggaucgccgccagcaucauccuggaguucuuccucaucguccugcugauccccgagcccgagaagcagcgcacgccccaggacaaccagcucacguacguggugaucgccauccugaccgucguggcggccaccauggccaacgagaugggcuuccuggagaagaccaagaaggaccucgggcugggcuccaucgccacgcagcagccggagagcaacauccuggacaucgaccuccggcccgccuccgcguggacccuguacgccguggccaccaccuucgucacgcccaugcugcgccacagcaucgagaacagcuccgugaacgugagccucaccgccaucgccaaccaggcgaccguccugaugggccuggggaagggcuggccccucuccaagauggacaucggggugccgcugcuggccaucggcugcuacagccaggugaaccccaucacccucacggccgcccugcugcuccuggucgcgcacuacgccaucaucgggcccggccugcaggccaaggccacccgggaggcccagaagcgcgcggccgccggcaucaugaagaaccccaccguggacgggaucaccgugaucgaccucgacccgauccccuacgaccccaaguucgagaagcagcugggccaggucaugcugcucauccugugcgugacccaggugcugaugaugcggaccaccugggcccucugcgaggcccugacccuggcgacggggcccaucuccacccucugggagggcaacccggggcgcuucuggaacaccaccaucgccgucagcauggccaacaucuuccggggcuccuaccuggccggcgccgggcuccucuucagcaucaugaagaacacgaccaacacccgccgcggcaccgggaacaucggcgagacgcugggcgagaaguggaagucccggcugaacgcgcucggcaagagcgaguuccagaucuacaagaaguccggcauccaggagguggaccgcacccuggccaaggaggggaucaagcggggcgagaccgaccaccacgccgugagccgcggguccgccaagcugcggugguucgucgagcgcaacauggugacccccgagggcaagguggucgaccucggcugcgggcggggcggguggagcuacuacugcggcgggcugaagaacgugcgcgaggugaagggccugacgaagggcgggcccggccacgaggagcccaucccgauguccaccuacggguggaaccucguccggcugcagagcggcguggacguguucuucaucccgcccgagaagugcgacacccugcucugcgacaucggggaguccagccccaacccgaccgucgaggcgggccgcacgcugcggauccugaaccucguggagaacuggcugaacaacaacacccaguucugcaucaaggugcugaaccccuacaugcccuccgucaucgagaagauggaggcccugcagcgcaaguacggcggggcccucgugcggaacccgcugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacgcgcaacaucgggaucgaguccgagauccccaaccuggacaucaucggcaagcggaucgagaagaucaagcaggagcacgaggcgagcuggcacuacgaccaggaccaccccuacaagaccugggccuaccacggcuccuacgagaccaagcagaccgggagcgccuccagcauggucaacggcguggugcgccugcucacgaagccgugggacguccugcccaccgugacccagauggccaugaccgacacgacccccuucgggcagcagcgcguguucaaggagaaggucgacacccggacccaggagcccaaggagggcacgaagaagcugaugaagaucaccgccgaguggcucuggaaggagcugggcaagaagaagaccccgcgcaugugcacccgggaggaguucacgcgcaaggugcgguccaacgcggcccugggggccaucuucaccgacgagaacaaguggaaguccgcccgcgaggccguggaggacucccgguucugggagcucgucgacaaggagcgcaaccugcaccuggagggcaagugcgagaccugcguguacaacaugauggggaagcgggagaagaagcucggcgaguucgggaaggcgaagggcagccgcgccaucugguacauguggcugggcgcccgguuccuggaguucgaggcccucggguuccugaacgaggaccacugguucucccgcgagaacagccuguccggcguggagggggagggccuccacaagcugggguacauccugcgggacgucagcaagaaggagggcggcgcgauguacgccgacgacaccgccgggugggacacgcgcaucacccucgaggaccugaagaacgaggagauggugaccaaccacauggagggcgagcacaagaagcuggccgaggccaucuucaagcucaccuaccagaacaaggucgugcgggugcagcgccccacgccccgggggaccgucauggacaucaucagccgccgggaccagcgcggcuccggccaggugggcaccuacggccugaacaccuucacgaacauggaggcgcagcugauccggcagauggagggggagggcguguucaagaacauccagcaccucaccgucaccgaggagguggccgugcacaacuggcuggcccgcgucgggugcgagcgccugagccggauggccaucuccggcgacgacugcguggugaagccccucgacgaccgcuucgccaacgcgcugaccgcccugaacgacaugggcaagauccggaaggacauccagcagugggagccgagcaagggguggaacgacuggacgcagguccccuucugcucccaccacuuccacgagcucaucaugaaggacggccgcgugcuggugguccccugccggaaccaggacgagcugaucgggcgcgcccggaucagccagggcgccggguggucccuccgcgagaccgccugccugggcaagagcuacgcgcagauguggucccugauguacuuccaccggcgcgaccuccggcuggccgccaacgccaucugcagcgccgugcccucccacugggugccgaccagccgcaccacgugguccauccacgcgaagcacgaguggaugaccaccgaggacaugcugaccgucuggaaccggguguggauccucgagaaccccuggauggaggacaagacccccguggagagcugggaggagauccccuaccugggcaagcgcgaggaccaguggugcgggucccugaucggccucacgagccgggccaccugggccaagaacauccaggccgcgaucaaccagguccgcucccugaucgggaacgaggaguacaccgacuacaugccgagcaugaagcgguuccgccgggaggaggaggaggccggcgugcugugguga

SEQ ID NO: 9591 - RNA, 9876 nt, Artificial Sequence
  derived and/or modified CDS sequence (opt1) from DENV-2__EU482777__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacaugggcgagacgcugggcgagaaguggaagucccgccugaacgcccucgggaaguccgaguuccagaucuacaagaaguccggcauccaggaggucgaccggacccuggcgaaggaggggaucaagcgcggcgagaccgaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugacgaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgaccguggaggccggccggacgcugcgcguccugaaccucguggagaacuggcugaacaacaacacccaguucugcaucaaggugcugaaccccuacaugcccuccgucaucgagaagauggaggcgcugcagcggaaguacggcggggcccucgugcgcaacccgcugagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggucaacggcguggugcggcugcucaccaagccgugggacguccugcccaccgugacccagauggccaugacggacaccacccccuucgggcagcagcgcguguucaaggagaaggucgacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggcgaucuucaccgacgagaacaaguggaaguccgcccgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcgucgagggggagggccuccacaagcugggguacauccugcgcgacgugagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggucgugcgcgugcagcggcccacgccccgggggaccgucauggacaucaucagccggcgcgaccagcggggcuccggccagguggggaccuacggccugaacacguucaccaacauggaggcccagcugauccgccagauggagggggagggcguguucaagaacauccagcaccucaccgucaccgaggagguggccgugcagaacuggcuggcgcgggucgggcgcgagcgccugagccggauggccaucuccggcgacgacugcguggugaagccccucgacgaccgcuucgccaacgcccugacggcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccgugcccucccacugggugccgaccagccgcacgaccugguccauccacgccaagcacgaguggaugaccaccgaggacaugcugaccgucuggaaccggguguggauccgcgagaaccccuggauggaggacaagacgcccguggagagcugggaggagauccccuaccucggcaagcgggaggaccaguggugcgggucccugaucggccugaccagccgcgccaccugggcgaagaacauccaggccgccaucaaccagguccggucccucaucgggaacgaggaguacaccgacuacaugccgagcaugaagcgcuuccggcgcgaggaggaggaggccggcgugcugugguga

SEQ ID NO: 9592 - RNA, 9876 nt, Artificial Sequence
  derived and/or modified CDS sequence (opt1) from DENV-2__EU482778__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucagcaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucgggggcguguucaccagcaucgggaaggcccuccaccaggucuucggcgccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgacaucaaggggaucaugcaggccggcaagcggucccugcgcccccagcccaccgagcugaaguacagcuggaagaccuggggcaaggccaagaugcucuccaccgagagccacaaccagacguuccugaucgacgggccggagaccgccgagugccccaacaccaaccgggccuggaacucccuggagguggaggacuacggcuucgggguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggugaagaacugccacuggcccaagagccacacccugugguccaacggcguccuggagagcgagaugaucauccccaaguccuucgccgggccggugagccagcacaacuaccgccccggcuacuacacccagaccgccgggcccuggcaccucggcaagcuggagauggacuucgacuucugcgaggggacgaccguggucgugaccgaggacugcggcaaccggggccccucccugcgcaccacgaccgccagcgggaagcucaucaccgaguggugcugccggagcugcacccugccgccccugcgcuaccggggcgaggacgggugcugguacggcauggagauccgcccccucaaggagaaggaggagaaccuggugaacucccuggucacggcggggcacggccagaucgacaacuucagccucggcgugcuggggauggcccuguuccucgaggagaugcugcggacccgcgugggcaccaagcacgccauccugcucgucgccguguccuucgugacccugaucacggggaacaugagcuuccgggaccugggccgcgucauggugauggugggggccgcgaugaccgacgacaucggcaucggcgucaccuaccucgcccugcuggccgccuucaaggugcgccccaccuucgccgcggggcuccugcugcggaagcucacguccaaggagcugaugauggccaccaucggcaucgcccugcucagccaguccaccaucccggagaccauccuggagcugacggacgcccucgcccuggggaugauggugcugaagaucguccgcaacauggagaaguaccagcucgcggugaccaucauggccaucagcugcgugcccaacgccgucauccugcagaacgccuggaagguguccugcaccauccuggcgaccgugagcgucagcccccuccugcugacgagcucccagcagaaggccgacuggaucccccucgcccugaccaucaagggccugaacccgaccgccaucuuccucaccacgcugagccggaccuccaagaagcgcagcuggccccugaacgaggccaucauggcggugggcauggucuccauccucgccagcucccugcugaagaacgacauccccaugaccgggccccucguggccggcgggcugcugaccgugugcuacguccucacgggccggagcgccgaccuggagcuggagcgcgccaccgacgugaagugggaggaccaggcggagaucagcggguccagcccgauccucuccaucaccaucgccgaggacggcagcauguccaucaagaacgaggaggaggagcagacccugacgauccugauccggaccggccuccuggugaucagcgggcuguuccccgucuccauccccaucaccgccgccgccugguaccucugggaggugaagaagcagcgcgcgggcgugcugugggacguccccagcccgccgcccguggggaaggccgagcuggaggacggcgccuaccggaucaagcagaaggggauccucggcuacucccagaucggcgccgggguguacaaggagggcaccuuccacaccauguggcacgucacgcgcggggccgugcugaugcaccggggcaagcgcaucgagccgagcugggcggacgugaagaaggaccugaucuccuacgggggcggcuggaagcucgagggggaguggaaggagggcgaggagguccaggugcuggcccuggagcccgggaagaacccccgggccgugcagaccaagcccggccucuucaagaccaacaccgggacgaucggcgccgucagccuggacuucuccccgggcaccagcgggucccccaucguggacaagaagggcaagguggucgggcuguacggcaacggcguggugacccgcagcggggcguacgucuccgccaucgcccagaccgagaaguccaucgaggacaaccccgagaucgaggacgacaucuuccggaagaagcgccucacgaucauggaccugcaccccggcgccgggaagaccaagcgguaccugccggccaucgugcgcgaggcgaucaagcggggccugcgcacccucauccuggcccccacccggguggucgccgccgagauggaggaggcccugcgcgggcuccccauccgcuaccagacgcccgcgauccgggccgagcacaccggccgcgagaucguggaccugaugugccacgccaccuucaccaugcggcugcucuccccggugcgcguccccaacuacaaccugaucaucauggacgaggcccacuucacggaccccgccagcaucgcggcccggggcuacaucagcacccgcguggagaugggggaggccgccggcaucuucaugaccgcgacgccgcccgggucccgggaccccuucccccagagcaacgcccccaucauggacgaggagcgcgagauccccgagcgguccuggaacagcggccacgagugggugacggacuucaaggggaagaccgucugguucgugcccuccaucaaggccggcaacgacaucgccgccugccugcgcaagaacggcaagaaggugauccagcucagccggaagaccuucgacuccgaguacgucaagacccgcacgaacgacugggacuucguggugaccaccgacaucagcgagaugggggcgaacuucaaggccgagcgggucaucgacccccgccggugcaugaagcccgugauccugaccgacggcgaggagcgcgugauccuggccgggccgaugcccgucacgcacuccagcgccgcccagcggcgcggccggaucgggcgcaaccccaagaacgagaacgaccaguacaucuacaugggcgagccccucgagaacgacgaggacugcgcgcacuggaaggaggccaagaugcugcuggacaacaucaacaccccggagggcaucauccccuccauguucgagcccgagcgcgagaagguggacgccaucgacggggaguaccggcuccgcggcgaggcccggaagaccuucguggaccugaugcgccgcggggaccugccggucuggcucgccuaccgcguggcggccgagggcaucaacuacgccgaccggcgcuggugcuucgacggggugaagaacaaccagauccuggaggagaacgucgagguggagaucuggaccaaggagggcgagcggaagaagcugaagccccgcuggcucgacgcccggaucuacagcgacccccuggcgcugaaggaguucaaggaguucgccgccggccgcaagucccucacgcugaaccugaucaccgagauggggcggcuccccaccuucaugacccagaaggcccgcgacgcccuggacaaccuggcggugcuccacacggccgaggccggcgggcgggccuacaaccacgcccugagcgagcugccggagacccucgagacccugcugcuccugacccugcucgcgacggucaccggcggcaucuuccuguuccugauguccgggaagggcguggggaagaugacccucggcaugugcugcaucaucaccgccagcauccugcuguggcacgcccagauccagccccacuggaucgccgccuccaucauccucgaguucuuccugaucguccugcucauccccgagcccgagaagcagcgcaccccgcaggacaaccagcugacguacguggugaucgcgauccugaccgucguggccgccaccauggccaacgagaugggguuccucgagaagaccaagaaggaccugggccugggcagcaucgccacgcaggagcccgaguccaacauccucgacaucgaccugcggcccgcgagcgccuggacccuguacgccguggccaccaccuucgucacgcccaugcuccgccacagcaucgagaacuccagcgugaacgugucccugaccgcgaucgccaaccaggccaccguccugauggggcucggcaagggguggccgcugagcaagauggacaucggcgugccccugcucgccaucgggugcuacucccaggugaaccccaucacccugacggccgcgcugcuccugcuggucgcccacuacgccaucaucggccccggccuccaggccaaggccacccgggaggcgcagaagcgcgccgccgccgggaucaugaagaacccgaccguggacggcaucaccgugaucgaccuggaccccauccccuacgaccccaaguucgagaagcagcuggggcaggucaugcuccugauccugugcgugacccaggugcucaugaugcggaccaccugggcccugugcgaggcgcugacccucgccacgggcccgaucagcacccugugggaggggaaccccggccgcuucuggaacaccaccaucgccgucuccauggccaacaucuuccgcggcagcuaccuggcgggggccggccuccuguucuccaucaugaagaacacgaccaacacccggcgcgggaccggcaacaucggcgagacgcugggggagaaguggaagucccggcucaacgcccugggcaaguccgaguuccagaucuacaagaaguccgggauccaggagguggaccgcacccuggccaaggagggcaucaagcgcggggagaccgaccaccacgccgugucccgcggcagcgcgaagcuccggugguucgucgagcgcaacauggugacccccgagggcaagguggucgaccuggggugcggccgcgggggcugguccuacuacugcgggggccugaagaacgugcgcgaggugaagggccucacgaagggcggccccgggcacgaggagccgguccccaugagcaccuacggcuggaaccuggugcggcugcaguccgggguggacgucuucuucacgccgcccgagaagugcgacacccuccugugcgacaucggcgagagcuccccgaaccccacgaucgaggccggccgcacccugcgggugcucagccugguggagaacuggcugaacaacgacacccaguucugcaucaagguccucaaccccuacaugccgagcgugaucgagaagauggagacccugcagcgcaaguacgggggcgcccuggugcggaacccccugucccgcaacagcacccacgagauguacugggucuccaacgccacggggaacaucgugagcuccgugaacaugaucagccggaugcucaucaaccgcuucaccaugaagcacaagaaggccaccuacgagcccgacgucgaccugggcuccgggacccggaacaucggcaucgagagcgagauccccaaccuggacaucaucggcaagcgcaucgagaagaucaagcaggagcacgagacguccuggcacuacgaccaggaccacccguacaagaccugggcguaccacgggagcuacgagaccaagcagaccggcuccgccagcuccauggugaacggggugguccgccuccugacgaagcccugggacguggugcccauggucacccagauggccaugaccgacaccacgcccuucggccagcagcggguguucaaggagaagguggacacccgcacccaggagccgaaggagggcaccaagaagcugaugaagaucacggccgaguggcucuggaaggagcuggggaagaagaagacgccccggaugugcacccgcgaggaguucacccggaagguccgcagcaacgccgcgcugggcgccaucuucacggacgagaacaaguggaaguccgcccgggaggccguggaggacagccgcuucugggagcucguggacaaggagcggaaccugcaccuggaggggaagugcgagaccugcgucuacaacaugaugggcaagcgcgagaagaagcucggggaguucggcaaggcgaagggcucccgggccaucugguacauguggcugggggcccgcuuccuggaguucgaggcccucggcuuccugaacgaggaccacugguucagccgggagaacucccugagcgggguggagggcgaggggcuccacaagcugggcuacauccugcgcgacgucagcaagaaggagggcggggccauguacgcggacgacaccgccggcugggacacccggaucacgcucgaggaccugaagaacgaggagauggugaccaaccacauggagggggagcacaagaagcuggccgaggccaucuucaagcucaccuaccagaacaaggugguccgcgugcagcggcccacgccccggggcacggugauggacaucaucucccggcgcgaccagcgggggagcggccaggucggcaccuacgggcugaacaccuucaccaacauggaggcccagcugauccgccagauggagggcgaggggaucuucaaguccauccagcaccucacggugaccgaggagaucgcggugcagaacuggcuggcccgcgucggccgggagcgccugagccggauggccaucuccggcgacgacugcguggugaagccgcucgacgaccgcuucgccagcgcccugaccgcgcugaacgacauggggaagguccggaaggacauccagcagugggagcccucccgcggcuggaacgacuggacccaggugcccuucugcagccaccacuuccacgagcucaucaugaaggacgggcgggugcuggucgugcccugccgcaaccaggacgagcugaucggccgggcccgcaucucccagggggccggcuggagccucaaggagacggccugccugggcaaguccuacgcccagauguggagccugauguacuuccaccggcgcgaccuccggcuggcggccaacgccaucugcuccgccgugccgagccacuggguccccaccucccgcaccaccuggagcauccacgcgaagcacgaguggaugaccacggaggacaugcugaccguguggaaccggguguggauccaggagaaccccuggauggaggacaagacccccgucgaguccugggaggaggugccguaccucgggaagcgcgaggaccaguggugcggcagccugaucgggcugaccagccgggccacgugggccaagaacauccagaccgccaucaaccaggugcgcucccucaucggcaacgaggaguacaccgacuacaugcccagcaugaagcgguuccgccgcgaggaggaggaggccgggguccugugguga

SEQ ID NO: 9593 - RNA, 9876 nt, Artificial Sequence
  derived and/or modified CDS sequence (opt1) from DENV-2__EU482779__SS-prME
accgccggcgugaucaucaugcugauccccaccgccauggcguuccaccucaccacccgcaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacccuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgacaucaaggggaucaugcaggccggcaagcggucccugcgcccccagcccaccgagcugaaguacagcuggaagaccuggggcaaggccaagaugcucuccaccgagagccacaaccagacguuccugaucgacgggccggagaccgccgagugccccaacaccaaccgggccuggaacucccuggagguggaggacuacggcuucgggguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggucaagagcugccacuggcccaagucccacacccuguggagcaacggcgugcuggaguccgagaugaucauccccaagagcuucgccgggccggugucccagcacaacuaccgccccggcuacuacacccagaccgccgggcccuggcaccucggcaagcuggagauggacuucgacuucugcgaggggacgaccguggucgugaccgaggacugcggcaaccggggccccagccugcgcaccacgaccgccagcgggaagcucaucaccgaguggugcugccgguccugcacccugccgccccugcgcuaccggggcgaggacgggugcugguacggcauggagauccgcccccucaaggagaaggaggagaaccuggugaacagccuggucacggcggggcacggccagaucgacaacuucucccucggcgugcuggggauggcccuguuccucgaggagaugcugcggacccgcgugggcaccaagcacgccauccugcucgucaccgugagcuucgugacgcugaucaccgggaacauguccuuccgggaccugggccgcgucauggugauggugggggccgccaugaccgacgacaucggcaugggcgucaccuaccucgcgcugcuggccgccuucaaggugcgccccacguucgccgccgggcuccugcugcggaagcucaccagcaaggagcugaugauggcgaccaucggcaucgcccugcucucccagagcaccaucccggagacgauccuggagcugaccgacgcccucgcccuggggaugauggugcugaagaucguccgcaacauggagaaguaccagcucgccgugaccaucauggcgaucuccugcgugcccaacgccgucauccugcagaacgccuggaaggugagcugcaccauccuggccgcgguguccgucagcccccuccugcugacguccagccagcagaaggccgacuggaucccccucgcccugaccaucaagggccugaacccgaccgccaucuuccucaccacgcugucccggaccagcaagaagcgcuccuggccccugaacgaggccaucauggcggugggcauggucagcauccucgccuccagccugcugaagaacgacauccccaugaccgggccccucguggccggcgggcugcugaccgugugcuacguccucacgggccggagcgccgaccuggagcuggagcgcgccaccgacgugaagugggaggaccaggcggagaucuccgggagcuccccgauccucagcaucaccaucgccgaggacggcuccaugagcaucaagaacgaggaggaggagcagacccugacgauccugauccggaccggccuccuggugaucuccgggcuguuccccgucagcauccccaucaccgccgccgccugguaccucugggaggugaagaagcagcgcgcgggcgugcugugggacguccccuccccgccgcccguggggaaggccgagcuggaggacggcgccuaccggaucaagcagaaggggauccucggcuacagccagaucggcgccgggguguacaaggagggcaccuuccacaccauguggcacgucacgcgcggggccgugcugaugcaccggggcaagcgcaucgagccguccugggcggacgugaagaaggaccugaucagcuacgggggcggcuggaagcucgagggggaguggaaggagggcgaggagguccaggugcuggcccuggagcccgggaagaacccccgggccgugcagaccaagcccggccucuucaagaccaacaccgggacgaucggcgccgucucccuggacuucagcccgggcaccuccgggagccccaucguggaccgcaagggcaagguggucgggcuguacggcaacggcguggugacccgguccggggcguacgucagcgccaucgcccagaccgagaaguccaucgaggacaaccccgagaucgaggacgacaucuuccgcaagaagcggcucacgaucauggaccugcaccccggcgccgggaagaccaagcgcuaccugccggccaucgugcgggaggcgaucaagcgcggccugcggacccucauccuggcccccacccgcguggucgccgccgagauggaggaggcccugcgcgggcuccccauccgguaccagacgcccgcgauccgcgccgagcacaccggccgggagaucguggaccugaugugccacgccaccuucaccaugcgccugcucagcccggugcggguccccaacuacaaccugaucaucauggacgaggcccacuucacggaccccgccagcaucgcggcccgcggcuacaucuccacccggguggagaugggggaggccgccggcaucuucaugaccgcgacgccgcccgggagccgcgaccccuucccccaguccaacgcccccaucauggacgaggagcgggagauccccgagcgcagcuggaacuccggccacgagugggugacggacuucaaggggaagaccgucugguucgugcccagcaucaaggccggcaacgacaucgccgccugccugcggaagaacggcaagaaggugauccagcucucccgcaagaccuucgacagcgaguacgucaagacccggacgaacgacugggacuucguggugaccaccgacaucuccgagaugggggcgaacuucaaggccgagcgcgucaucgacccccggcgcugcaugaagcccgugauccugaccgacggcgaggagcgggugauccuggccgggccgaugcccgucacgcacagcuccgccgcccagcgccggggccgcaucgggcgcaaccccaagaacgagaacgaccaguacaucuacaugggcgagccccucgagaacgacgaggacugcgcgcacuggaaggaggccaagaugcugcuggacaacaucaacaccccggagggcaucauccccagcauguucgagcccgagcgggagaagguggacgccaucgacggggaguaccgccuccggggcgaggcccgcaagaccuucguggaccugaugcggcgcggggaccugccggucuggcucgccuaccggguggcggccgagggcaucaacuacgccgaccgccgguggugcuucgacggggugaagaacaaccagauccuggaggagaacgucgagguggagaucuggaccaaggagggcgagcgcaagaagcugaagccccgguggcucgacgcccgcaucuacuccgacccccuggcgcugaaggaguucaaggaguucgccgccggccgcaagagccucacgcugaaccugaucaccgagauggggcgccuccccaccuucaugacccagaaggcccgggacgcccuggacaaccuggcggugcuccacacggccgaggccggcgggcgcgccuacaaccacgcccuguccgagcugccggagacccucgagacccugcugcuccugacccugcucgcgacggucaccggcggcaucuuccuguuccugaugagcgggaagggcguggggaagaugacccucggcaugugcugcaucaucaccgccuccauccugcugugguacgcccagauccagccccacuggaucgccgccagcaucauccucgaguucuuccugaucguccugcucauccccgagcccgagaagcagcggaccccgcaggacaaccagcugacguacguggugaucgcgauccugaccgucguggccgccaccauggccaacgagaugggguuccucgagaagaccaagaaggaccugggccugggcuccaucgccacgcaggagcccgagagcaacauccucgacaucgaccugcgccccgcgagcgccuggacccuguacgccguggccaccaccuucgucacgcccaugcuccggcacuccaucgagaacagcuccgugaacgugagccugaccgcgaucgccaaccaggccaccguccugauggggcucggcaagggguggccgcuguccaagauggacaucggcgugccccugcucgccaucgggugcuacagccaggugaaccccaucacccugacggccgcgcugcuccugcuggucgcccacuacgccaucaucggccccggccuccaggccaaggccacccgcgaggcgcagaagcgggccgccgccgggaucaugaagaacccgaccguggacggcgugaccgucaucgaccuggaccccauccccuacgaccccaaguucgagaagcagcugggccaggugaugcuccugauccugugcgugacgcagguccucaugaugcgcaccaccugggcccugugcgaggcgcugacccucgccacgggcccgaucuccacccugugggaggggaaccccggccgcuucuggaacaccaccaucgccgugagcauggccaacaucuuccggggcuccuaccuggcgggggccggccuccuguucagcaucaugaagaacacgaccaacacccgccgggggaccggcaacaucggcgagacgcugggggagaaguggaagucccgccucaacgcccugggcaagagcgaguuccagaucuacaagaaguccgggauccaggagguggaccggacccuggccaaggagggcaucaagcgcggggagaccgaccaccacgccgucagccggggcuccgcgaagcuccgcugguucguggagcggaacauggugacccccgagggcaaggucguggaccuggggugcggccgcgggggcuggagcuacuacugcgggggccugaaggacgugcgggaggucaagggccucacgaagggcgggcccgggcacgaggagccgauccccauguccaccuacggcuggaaccuggugcgccugcagagcgggguggacgucuucuucacgccgcccgagaagugcgacacccuccugugcgacaucggcgaguccagcccgaaccccacgaucgaggccggccggacccugcgcgugcucagccugguggagaacuggcugaacaacgacacccaguucugcaucaagguccucaaccccuacaugccguccgugaucgagaagauggagacccugcagcggaaguacgggggcgcccuggugcgcaacccccugagccggaacuccacccacgagauguacugggucagcaacgccacggggaacaucguguccagcgugaacaugaucucccgcaugcucaucaaccgguucaccaugaagcacaagaaggccaccuacgagcccgacgucgaccugggcagcgggacccgcaacaucggcaucgaguccgagauccccaaccuggacaucaucggcaagcgcaucgagaagaucaagcaggagcacgagacgagcuggcacuacgaccaggaccacccguacaagaccugggcguaccacggguccuacgagaccaagcagaccggcagcgccuccagcauggugaacggggugguccggcuccugacgaagcccugggacguggugcccauggucacccagauggccaugaccgacaccacgcccuucggccagcagcgcguguucaaggagaagguggacacccggacccaggagccgaaggagggcaccaagaagcugaugaagaucacggccgaguggcucuggaaggagcuggggaagaagaagacgccccggaugugcacccgggaggaguucacccgcaagguccgguccaacgccgcgcugggcgccaucuucacggacgagaacaaguggaaguccgcccgcgaggccguggaggacucccgguucugggagcucguggacaaggagcgcaaccugcaccuggaggggaagugcgagaccugcgucuacaacaugaugggcaagcgggagaagaagcucggggaguucggcaaggcgaagggcagccgcgccaucugguacauguggcugggggcccgguuccuggaguucgaggcccucggcuuccugaacgaggaccacugguucucccgcgagaacagccugagcgggguggagggcgaggggcuccacaagcugggcuacauccugcgggacgucuccaagaaggagggcggggccauguacgcggacgacaccgccggcugggacacccgcaucacgcucgaggaccugaagaacgaggagauggugaccaaccacauggagggggagcacaagaagcuggccgaggccaucuucaagcucaccuaccagaacaaggugguccgggugcagcgccccacgccccggggcacggugauggacaucaucagccgccgggaccagcgcggguccggccaggucggcaccuacgggcugaacaccuucaccaacauggaggcccagcugauccgccagauggagggcgaggggguguucaagagcauccagcggcucacggugaccgaggagaucgcgguccagaacuggcuggcccgcgugggccgggagcgccugucccggauggccaucagcggcgacgacugcguggucaagccgcucgacgaccgcuucgccuccgcccugaccgcgcugaacgacauggggaaggugcggaaggacauccagcagugggagcccagccgcggcuggaacgacuggacccaggugcccuucugcucccaccacuuccacgagcucaucaugaaggacgggcggguccugguggugcccugccgcaaccaggacgagcugaucggccgggcccgcaucagccagggggccggcuggucccucaaggagacggccugccugggcaagagcuacgcccagauguggucccugauguacuuccaccggcgcgaccuccggcuggcggccaacgccaucugcagcgccgucccgucccacugggugcccaccagccgcaccaccugguccauccacgcgaagcacgaguggaugaccacggaggacaugcugaccguguggaaccgggucuggauccaggagaaccccuggauggaggacaagacccccguggagagcugggaggaggugccguaccucgggaagcgcgaggaccaguggugcggcagccugaucgggcugaccucccgggccacgugggccaagaacauccagaccgccaucaaccagguccgcagccucaucggcaacgaggaguacaccgacuacaugcccuccaugaagcgcuuccggcgcgaggaggaggaggccggggugcugugguga

SEQ ID NO: 9594 - RNA, 9876 nt, Artificial Sequence
  derived and/or modified CDS sequence (opt1) from DENV-2__EU482780__SS-prME
accgccggcgugaucaucaugcugauccccaccgccauggcguuccaccucaccacccgcaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacccuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgacaucaaggggaucaugcaggccggcaagcggucccugcgcccccagcccaccgagcugaaguacagcuggaagaccuggggcaaggccaagaugcucuccaccgagagccacaaccagacguuccugaucgacgggccggagaccgccgagugccccaacaccaaccgggccuggaacucccuggagguggaggacuacggcuucgggguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggucaagagcugccacuggcccaagucccacacccuguggagcaacggcgugcuggaguccgagaugaucauccccaagagcuucgccgggccggugucccagcacaacuaccgccccggcuacuacacccagaccgccgggcccuggcaccucggcaagcuggagauggacuucgacuucugcgaggggacgaccguggucgugaccgaggacugcggcaaccggggccccagccugcgcaccacgaccgccagcgggaagcucaucaccgaguggugcugccgguccugcacccugccgccccugcgcuaccggggcgaggacgggugcugguacggcauggagauccgcccccucaaggagaaggaggagaaccuggugaacagccuggucacggcggggcacggccagaucgacaacuucucccucggcgugcuggggauggcccuguuccucgaggagaugcugcggacccgcgugggcaccaagcacgccauccugcucgucaccgugagcuucgugacgcugaucaccgggaacauguccuuccgggaccugggccgcgucauggugauggugggggccgccaugaccgacgacaucggcaugggcgucaccuaccucgcgcugcuggccgccuucaaggugcgccccacguucgccgccgggcuccugcugcggaagcucaccagcaaggagcugaugauggcgaccaucggcaucgcccugcucucccagagcaccaucccggagacgauccuggagcugaccgacgcccucgcccuggggaugauggugcugaagaucguccgcaacauggagaaguaccagcucgccgugaccaucauggcgaucuccugcgugcccaacgccgucauccugcagaacgccuggaaggugagcugcaccauccuggccgcgguguccgucagcccccuccugcugacguccagccagcagaaggccgacuggaucccccucgcccugaccaucaagggccugaacccgaccgccaucuuccucaccacgcugucccggaccagcaagaagcgcuccuggccccugaacgaggccaucauggcggugggcauggucagcauccucgccuccagccugcugaagaacgacauccccaugaccgggccccucguggccggcgggcugcugaccgugugcuacguccucacgggccggagcgccgaccuggagcuggagcgcgccaccgacgugaagugggaggaccaggcggagaucuccgggagcuccccgauccucagcaucaccaucgccgaggacggcuccaugagcaucaagaacgaggaggaggagcagacccugacgauccugauccggaccggccuccuggugaucuccgggcuguuccccgucagcauccccaucaccgccgccgccugguaccucugggaggugaagaagcagcgcgcgggcgugcugugggacguccccuccccgccgcccguggggaaggccgagcuggaggacggcgccuaccggaucaagcagaaggggauccucggcuacagccagaucggcgccgggguguacaaggagggcaccuuccacaccauguggcacgucacgcgcggggccgugcugaugcaccggggcaagcgcaucgagccguccugggcggacgugaagaaggaccugaucagcuacgggggcggcuggaagcucgagggggaguggaaggagggcgaggagguccaggugcuggcccuggagcccgggaagaacccccgggccgugcagaccaagcccggccucuucaagaccaacaccgggacgaucggcgccgucucccuggacuucagcccgggcaccuccgggagccccaucguggaccgcaagggcaagguggucgggcuguacggcaacggcguggugacccgguccggggcguacgucagcgccaucgcccagaccgagaaguccaucgaggacaaccccgagaucgaggacgacaucuuccgcaagaagcggcucacgaucauggaccugcaccccggcgccgggaagaccaagcgcuaccugccggccaucgugcgggaggcgaucaagcgcggccugcggacccucauccuggcccccacccgcguggucgccgccgagauggaggaggcccugcgcgggcuccccauccgguaccagacgcccgcgauccgcgccgagcacaccggccgggagaucguggaccugaugugccacgccaccuucaccaugcgccugcucagcccggugcggguccccaacuacaaccugaucaucauggacgaggcccacuucacggaccccgccagcaucgcggcccgcggcuacaucuccacccggguggagaugggggaggccgccggcaucuucaugaccgcgacgccgcccgggagccgcgaccccuucccccaguccaacgcccccaucauggacgaggagcgggagauccccgagcgcagcuggaacuccggccacgagugggugacggacuucaaggggaagaccgucugguucgugcccagcaucaaggccggcaacgacaucgccgccugccugcggaagaacggcaagaaggugauccagcucucccgcaagaccuucgacagcgaguacgucaagacccggacgaacgacugggacuucguggugaccaccgacaucuccgagaugggggcgaacuucaaggccgagcgcgucaucgacccccggcgcugcaugaagcccgugauccugaccgacggcgaggagcgggugauccuggccgggccgaugcccgucacgcacagcuccgccgcccagcgccggggccgcaucgggcgcaaccccaagaacgagaacgaccaguacaucuacaugggcgagccccucgagaacgacgaggacugcgcgcacuggaaggaggccaagaugcugcuggacaacaucaacaccccggagggcaucauccccagcauguucgagcccgagcgggagaagguggacgccaucgacggggaguaccgccuccggggcgaggcccgcaagaccuucguggaccugaugcggcgcggggaccugccggucuggcucgccuaccggguggcggccgagggcaucaacuacgccgaccgccgguggugcuucgacggggugaagaacaaccagauccuggaggagaacgucgagguggagaucuggaccaaggagggcgagcgcaagaagcugaagccccgguggcucgacgcccgcaucuacuccgacccccuggcgcugaaggaguucaaggaguucgccgccggccgcaagagccucacgcugaaccugaucaccgagauggggcgccuccccaccuucaugacccagaaggcccgggacgcccuggacaaccuggcggugcuccacacggccgaggccggcgggcgcgccuacaaccacgcccuguccgagcugccggagacccucgagacccugcugcuccugacccugcucgcgacggucaccggcggcaucuuccuguuccugaugagcgggaagggcguggggaagaugacccucggcaugugcugcaucaucaccgccuccauccugcugugguacgcccagauccagccccacuggaucgccgccagcaucauccucgaguucuuccugaucguccugcucauccccgagcccgagaagcagcggaccccgcaggacaaccagcugacguacguggugaucgcgauccugaccgucguggccgccaccauggccaacgagaugggguuccucgagaagaccaagaaggaccugggccugggcuccaucgccacgcaggagcccgagagcaacauccucgacaucgaccugcgccccgcgagcgccuggacccuguacgccguggccaccaccuucgucacgcccaugcuccggcacuccaucgagaacagcuccgugaacgugagccugaccgcgaucgccaaccaggccaccguccugauggggcucggcaagggguggccgcuguccaagauggacaucggcgugccccugcucgccaucgggugcuacagccaggugaaccccaucacccugacggccgcgcugcuccugcuggucgcccacuacgccaucaucggccccggccuccaggccaaggccacccgcgaggcgcagaagcgggccgccgccgggaucaugaagaacccgaccguggacggcgugaccgucaucgaccuggaccccauccccuacgaccccaaguucgagaagcagcugggccaggugaugcuccugauccugugcgugacgcagguccucaugaugcgcaccaccugggcccugugcgaggcgcugacccucgccacgggcccgaucuccacccugugggaggggaaccccggccgcuucuggaacaccaccaucgccgugagcauggccaacaucuuccggggcuccuaccuggcgggggccggccuccuguucagcaucaugaagaacacgaccaacacccgccgggggaccggcaacaucggcgagacgcugggggagaaguggaagucccgccucaacgcccugggcaagagcgaguuccagaucuacaagaaguccgggauccaggagguggaccggacccuggccaaggagggcaucaagcgcggggagaccgaccaccacgccgucagccggggcuccgcgaagcuccgcugguucguggagcggaacauggugacccccgagggcaaggucguggaccuggggugcggccgcgggggcuggagcuacuacugcgggggccugaaggacgugcgggaggucaagggccucacgaagggcgggcccgggcacgaggagccgauccccauguccaccuacggcuggaaccuggugcgccugcagagcgggguggacgucuucuucacgccgcccgagaagugcgacacccuccugugcgacaucggcgaguccagcccgaaccccacgaucgaggccggccggacccugcgcgugcucagccugguggagaacuggcugaacaacgacacccaguucugcaucaagguccucaaccccuacaugccguccgugaucgagaagauggagacccugcagcggaaguacgggggcgcccuggugcgcaacccccugagccggaacuccacccacgagauguacugggucagcaacgccacggggaacaucguguccagcgugaacaugaucucccgcaugcucaucaaccgguucaccaugaagcacaagaaggccaccuacgagcccgacgucgaccugggcagcgggacccgcaacaucggcaucgaguccgagauccccaaccuggacaucaucggcaagcgcaucgagaagaucaagcaggagcacgagacgagcuggcacuacgaccaggaccacccguacaagaccugggcguaccacggguccuacgagaccaagcagaccggcagcgccuccagcauggugaacggggugguccggcuccugacgaagcccugggacguggugcccauggucacccagauggccaugaccgacaccacgcccuucggccagcagcgcguguucaaggagaagguggacacccggacccaggagccgaaggagggcaccaagaagcugaugaagaucacggccgaguggcucuggaaggagcuggggaagaagaagacgccccggaugugcacccgggaggaguucacccgcaagguccgguccaacgccgcgcugggcgccaucuucacggacgagaacaaguggaaguccgcccgcgaggccguggaggacucccgguucugggagcucguggacaaggagcgcaaccugcaccuggaggggaagugcgagaccugcgucuacaacaugaugggcaagcgggagaagaagcucggggaguucggcaaggcgaagggcagccgcgccaucugguacauguggcugggggcccgguuccuggaguucgaggcccucggcuuccugaacgaggaccacugguucucccgcgagaacagccugagcgggguggagggcgaggggcuccacaagcugggcuacauccugcgggacgucuccaagaaggagggcggggccauguacgcggacgacaccgccggcugggacacccgcaucacgcucgaggaccugaagaacgaggagauggugaccaaccacauggagggggagcacaagaagcuggccgaggccaucuucaagcucaccuaccagaacaaggugguccgggugcagcgccccacgccccggggcacggugauggacaucaucagccgccgggaccagcgcggguccggccaggucggcaccuacgggcugaacaccuucaccaacauggaggcccagcugauccgccagauggagggcgaggggguguucaagagcauccagcggcucacggugaccgaggagaucgcgguccagaacuggcuggcccgcgugggccgggagcgccugucccggauggccaucagcggcgacgacugcguggucaagccgcucgacgaccgcuucgccuccgcccugaccgcgcugaacgacauggggaaggugcggaaggacauccagcagugggagcccagccgcggcuggaacgacuggacccaggugcccuucugcucccaccacuuccacgagcucaucaugaaggacgggcggaugcuggucgugcccugccgcaaccaggacgagcugaucggccgggcccgcaucagccagggggccggcuggucccucaaggagacggccugccugggcaagagcuacgcccagauguggucccugauguacuuccaccggcgcgaccuccggcuggcggccaacgccaucugcagcgccgugccgucccacuggguccccaccagccgcaccaccugguccauccacgcgaagcacgaguggaugaccacggaggacaugcugaccguguggaaccggguguggauccaggagaaccccuggauggaggacaagacccccgucgagagcugggaggaggugccguaccucgggaagcgcgaggaccaguggugcggcagccugaucgggcugaccucccgggccacgugggccaagaacauccagaccgccaucaaccaggugcgcagccucaucggcaacgaggaguacaccgacuacaugcccuccaugaagcgcuuccggcgcgaggaggaggaggccgggguccugugguga

SEQ ID NO: 9595 - RNA, 9876 nt, Artificial Sequence
  derived and/or modified CDS sequence (opt1) from DENV-2__EU482781__SS-prME
accgccggcgugaucaucaugcugauccccaccgccauggcguuccaccucaccacccgcaacggggagccgcacaugaucgucggccggcaggagaagggcaagagccugcuguucaagaccgaggacggggugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgacaucaaggggaucaugcagcccggcaagcggucccugcgcccccagccgaccgagcugaaguacagcuggaagaccuggggcaaggccaagaugcucuccaccgagagccacaaccagacguuccugaucgacgggcccgagaccgccgagugccccaacaccaaccgggccuggaacucccuggagguggaggacuacggcuucgggguguucaccacgaacaucuggcucaagcugcgcgagaagcaggacgucuucugcgacagcaagcugauguccgccgcgaucaaggacaaccgggccgugcacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucaucccgaaguccuucgcggggcccgugucccagcacaacuaccgccccggcuacuacacccagaccgccgggcccuggcaccucggcaagcuggagauggacuucgacuucugcgaggggacgaccguggucgugaccgaggacugcggcaaccggggcccgagccugcgcaccacgaccgccagcgggaagcucaucaccgaguggugcugccgguccugcacccugccgccccugcgcuaccggggcgaggacgggugcugguacggcauggagauccgcccccucaaggagaaggaggagaaccuggugaacagccuggucacggccgggcacggccagaucgacaacuucucccucggcgugcuggggauggcgcuguuccucgaggagaugcugcggacccgcgugggcaccaagcacgccauccugcucgucaccgugagcuucgugacgcugaucaccgggaacauguccuuccgggaccugggccgcgucauggugauggugggggccgccaugaccgacgacaucggcaugggcgucaccuaccucgcccugcuggcggccuucaaggugcgcccgacguucgccgccgggcuccugcugcggaagcucaccagcaaggagcugaugauggccaccaucggcaucgcgcugcucucccagagcaccauccccgagacgauccuggagcugaccgacgcccucgcccuggggaugauggugcugaagaucguccgcaacauggagaaguaccagcucgccgugaccaucauggccaucuccugcgugcccaacgcggucauccugcagaacgccuggaaggugagcugcaccauccuggccgccguguccgucagcccccuccugcugacguccagccagcagaaggcggacuggaucccgcucgcccugaccaucaagggccugaaccccaccgccaucuuccucaccacgcugucccggaccagcaagaagcgcuccuggccccugaacgaggccaucauggccgugggcauggucagcauccucgcguccagccugcugaagaacgacauccccaugaccgggccgcucguggccggcgggcugcugaccgugugcuacguccucacgggccggagcgccgaccuggagcuggagcgcgccaccgacgugaagugggaggaccaggccgagaucuccgggagcucccccauccucagcaucaccaucgcggaggacggcuccaugagcaucaagaacgaggaggaggagcagacccugacgauccugauccggaccggccuccuggugaucuccgggcuguuccccgucagcauccccaucaccgccgccgccugguaccucugggaggugaagaagcagcgcgccggcgugcugugggacgucccgagcccgccgcccguggggaaggcggagcuggaggacggcgccuaccggaucaagcagaaggggauccucggcuacagccagaucggcgccgggguguacaaggagggcaccuuccacaccauguggcacgucacgcgcggggccgugcugaugcaccggggcaagcgcaucgagcccuccugggccgacgugaagaaggaccugaucagcuacgggggcggcuggaagcucgagggggaguggaaggagggcgaggagguccaggugcuggcgcuggagcccgggaagaacccccgggccgugcagaccaagcccggccucuucaagaccaacaccgggacgaucggcgccgucucccuggacuucagccccggcaccuccgggagccccaucguggaccgcaagggcaagguggucgggcuguacggcaacggcguggugacccgguccggggccuacgucagcgcgaucgcccagaccgagaaguccaucgaggacaaccccgagaucgaggacgacaucuuccgcaagaagcggcucacgaucauggaccugcacccgggcgccgggaagaccaagcgcuaccugcccgccaucgugcgggaggccaucaagcgcggccugcggacccucauccuggcgcccacccgcguggucgccgccgagauggaggaggcccugcgcgggcuccccauccgguaccagacgccggccauccgcgcggagcacaccggccgggagaucguggaccugaugugccacgccaccuucaccaugcgccugcucagccccgugcggguccccaacuacaaccugaucaucauggacgaggcccacuucacggaccccgccagcaucgccgcgcgcggcuacaucuccacccggguggagaugggggaggccgccggcaucuucaugaccgccaccccgcccgggagccgcgaccccuucccccaguccaacgcgccgaucauggacgaggagcgggagauccccgagcgcagcuggaacuccggccacgagugggugacggacuucaaggggaagaccgucugguucgugcccagcaucaaggccggcaacgacaucgccgccugccugcggaagaacggcaagaaggugauccagcucucccgcaagaccuucgacagcgaguacgucaagacccggacgaacgacugggacuucguggugaccaccgacaucuccgagaugggggccaacuucaaggcggagcgcgucaucgacccccggcgcugcaugaagccggugauccugaccgacggcgaggagcgggugauccuggccgggcccaugcccgucacgcacagcuccgccgcccagcgccggggccgcaucgggcgcaaccccaagaacgagaacgaccaguacaucuacaugggcgagccgcucgagaacgacgaggacugcgcccacuggaaggaggcgaagaugcugcuggacaacaucaacacccccgagggcaucauccccagcauguucgagccggagcgggagaagguggacgccaucgacggggaguaccgccuccggggcgaggcccgcaagaccuucguggaccugaugcggcgcggggaccugcccgucuggcucgccuaccggguggccgcggagggcaucaacuacgccgaccgccgguggugcuucgacggggugaagaacaaccagauccuggaggagaacgucgagguggagaucuggaccaaggagggcgagcgcaagaagcugaagccccgguggcucgacgcccgcaucuacuccgacccccuggcccugaaggaguucaaggaguucgcggccggccgcaagagccucacgcugaaccugaucaccgagauggggcgccucccgaccuucaugacccagaaggcccgggacgcccuggacaaccuggccgugcuccacacggcggaggccggcgggcgcgccuacaaccacgcccuguccgagcugcccgagacccucgagacccugcugcuccugacccugcucgccacggucaccggcggcaucuuccuguuccugaugagcgggaagggcguggggaagaugacccucggcaugugcugcaucaucaccgcguccauccugcugugguacgcccagauccagccccacuggaucgccgccagcaucauccucgaguucuuccugaucguccugcucauccccgagccggagaagcagcggacgccccaggacaaccagcugacguacguggugaucgccauccugaccgucguggcggccaccauggccaacgagaugggguuccucgagaagaccaagaaggaccugggccugggcuccaucgccacgcaggagcccgagagcaacauccucgacaucgaccugcgccccgccagcgcguggacccuguacgccguggccaccaccuucgucacgccgaugcuccggcacuccaucgagaacagcuccgugaacgugagccugaccgccaucgcgaaccaggccaccguccugauggggcucggcaagggguggccccuguccaagauggacaucggcgugccccugcucgccaucgggugcuacagccaggugaaccccaucacccugacggccgcccugcuccugcuggucgcgcacuacgccaucaucggcccgggccuccaggccaaggccacccgcgaggcccagaagcgggcggccgccgggaucaugaagaaccccaccguggacggcgugaccgucaucgaccuggaccccauccccuacgacccgaaguucgagaagcagcugggccaggugaugcuccugauccugugcgugacgcagguccucaugaugcgcaccaccugggcccugugcgaggcccugacccucgcgacgggccccaucuccacccugugggaggggaaccccggccgcuucuggaacaccaccaucgccgugagcauggccaacaucuuccggggcuccuaccuggccggggcgggccuccuguucagcaucaugaagaacacgaccaacacccgccgggggaccggcaacaucggcgagacgcugggggagaaguggaagucccgccucaacgcccugggcaagagcgaguuccagaucuacaagaaguccgggauccaggagguggaccggacccuggccaaggagggcaucaagcgcggggagaccgaccaccacgccgucagccggggcuccgccaagcuccgcugguucguggagcggaacauggugacccccgagggcaaggucguggaccuggggugcggccgcgggggcuggagcuacuacugcgggggccugaaggacgugcgggaggucaagggccucacgaagggcggcccggggcacgaggagcccauccccauguccaccuacggcuggaaccuggugcgccugcagagcgggguggacgucuucuucacgccgcccgagaagugcgacacccuccugugcgacaucggcgaguccagccccaaccccacgaucgaggcgggccggacccugcgcgugcucagccugguggagaacuggcugaacaacgacacccaguucugcaucaagguccucaaccccuacaugcccuccgugaucgagaagauggagacccugcagcggaaguacgggggcgcccuggugcgcaacccccugagccggaacuccacccacgagauguacugggucagcaacgccacggggaacaucguguccagcgugaacaugaucucccgcaugcucaucaaccgguucaccaugaagcacaagaaggccaccuacgagcccgacgucgaccugggcagcgggacccgcaacaucggcaucgaguccgagaucccgaaccuggacaucaucggcaagcgcaucgagaagaucaagcaggagcacgagacgagcuggcacuacgaccaggaccaccccuacaagaccugggccuaccacggguccuacgagaccaagcagaccggcagcgcguccagcauggugaacggggugguccggcuccugacgaagcccugggacguggugcccauggucacccagauggccaugaccgacaccacgccguucggccagcagcgcguguucaaggagaagguggacacccggacccaggagcccaaggagggcaccaagaagcugaugaagaucacggccgaguggcucuggaaggagcuggggaagaagaagacgccccggaugugcacccgggaggaguucacccgcaagguccgguccaacgccgcccugggcgcgaucuucacggacgagaacaaguggaaguccgcccgcgaggccguggaggacucccgguucuggaagcucguggacaaggagcgcaaccugcaccuggaggggaagugcgagaccugcgucuacaacaugaugggcaagcgggagaagaagcucggggaguucggcaaggccaagggcagccgcgcgaucugguacauguggcugggggcccgguuccuggaguucgaggcccucggcuuccugaacgaggaccacugguucucccgcgagaacagccugagcgggguggagggcgaggggcuccacaagcugggcuacauccugcgggacgucuccaagaaggagggcggggccauguacgccgacgacaccgcgggcugggacacccgcaucacgcucgaggaccugaagaacgaggagauggugaccaaccacauggagggggagcacaagaagcuggccgaggccaucuucaagcucaccuaccagaacaaggugguccgggugcagcgccccaccccgcggggcacggugauggacaucaucagccgccgggaccagcgcggguccggccaggucggcaccuacgggcugaacaccuucaccaacauggaggcccagcugauccgccagauggagggcgaggggguguucaagagcauccagcggcucacggugaccgaggagaucgccguccagaacuggcuggcgcgcgugggccgggagcgccugucccggauggccaucagcggcgacgacugcguggucaagccccucgacgaccgcuucgccuccgcccugaccgcccugaacgacauggggaaggugcggaaggacauccagcagugggagcccagccgcggcuggaacgacuggacccaggugcccuucugcucccaccacuuccacgagcucaucaugaaggacgggcggguccugguggugccgugccgcaaccaggacgagcugaucggccgggcgcgcaucagccagggggccggcuggucccucaaggagacggccugccugggcaagagcuacgcccagauguggucccugauguacuuccaccggcgcgaccuccggcuggccgcgaacgccaucugcagcgccguccccucccacugggugcccaccagccgcaccaccugguccauccacgccaagcacgaguggaugaccacggaggacaugcugaccguguggaaccgggucuggauccaggagaaccccuggauggaggacaagaccccgguggagagcugggaggaggugcccuaccucgggaagcgcgaggaccaguggugcggcagccugaucgggcugaccucccgggcgacgugggccaagaacauccagaccgccaucaaccagguccgcagccucaucggcaacgaggaguacaccgacuacaugcccuccaugaagcgcuuccggcgcgaggaggaggaggccggggugcugugguga

SEQ ID NO: 9596 - RNA, 9876 nt, Artificial Sequence
  derived and/or modified CDS sequence (opt1) from DENV-2__EU482782__SS-prME
agcgccgggaugaucaucaugcugauccccaccgugauggccuuccaccucaccacccgcaacggggagccccacaugaucgucgggauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacauccgcggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgucgccggccugcugcuccgcaagcugaccuccaaggagcugaugaugaccacgaucgggaucgugcuccugagccaguccaccauccccgagaccgugcuggagcucaccgacgcccuggcccugggcaugaugguccucaagaucgugcgcaacauggagaaguaccagcuggcggucacgaucauggccauccugugcgugccgaacgccgugauccuccagaacgccuggaaggucagcugcaccauccuggccgugguguccgucagcccccugcuccugaccuccagccagcagaagaccgacuggaucccccuggcgcucacgaucaaggggcugaaccccaccgccaucuuccugaccacccucucccggacgaacaagaagcgcagcuggccgcugaacgaggccaucauggccgugggcaugguguccauccuggcgagcucccuccugaagaacgacauccccaugaccggcccccuggucgccgggggccuccugaccgugugcuacgugcugaccgggcggagcgccgaccucgagcuggagcgcgccacggacgucaagugggaggaccaggccgagaucuccggcagcagccccauccuguccaucaccaucagcgaggacggguccaugagcaucaagaacgaggaggaggagcagacccucaccauccugauccggacgggccugcucgugaucuccggccuguucccgaucagcauccccaucaccgcggccgccugguaccugugggaggugaagaagcagcgcgccgggguccucugggacgugcccagcccgccgcccaugggcaaggccgagcuggaggacggggcguaccggaucaagcagaagggcauccugggguacagccagaucggcgccggcguguacaaggaggggaccuuccacaccauguggcacgucacccgcggcgccgugcucaugcacaaggggaagcggaucgagcccuccugggccgacgugaagaaggaccugaucagcuacggcgggggcuggaagcuggagggcgaguggaaggagggggaggagguccaggugcucgcccuggagcccggcaagaacccccgcgcggugcagacgaagcccgggcuguucaagaccaacaccggcaccaucggggccgucucccucgacuucagccccggcacguccggcagccccaucaucgacaagaaggggaagguggugggccuguacgggaacggcgucgugacccgguccggcgccuacgugagcgccaucgcccagaccgagaaguccaucgaggacaaccccgagaucgaggacgacaucuuccgcaagcggcgccugaccaucauggaccugcaccccggggcgggcaagacgaagcgguaccuccccgccaucguccgcgaggccaucaagcgggggcugcgcacccugauccucgccccgacccgggugguggcggccgagauggaggaggcccugcgcggccugcccauccgguaccagacccccgccauccgcgccgagcacacggggcgcgagaucgucgaccucaugugccacgcgaccuucaccaugcggcugcugagccccgugcgcgugccgaacuacaaccucaucaucauggacgaggcccacuucaccgaccccgccuccaucgccgcccggggcuacaucagcacgcgcgucgagaugggcgaggcggccgggaucuucaugaccgccacgccgcccggcagccgggacccguucccccaguccaacgcccccaucaucgacgaggagcgcgagauccccgagcggagcuggaacuccgggcacgagugggugaccgacuucaagggcaagacggugugguucgucccgagcaucaaggccgggaacgacaucgcggccugccugcgcaagaacggcaagaaggugauccagcugucccggaagaccuucgacagcgaguacgugaagacccgcaccaacgacugggacuucgucgugacgaccgacaucuccgagaugggcgccaacuucaaggccgagcgggugaucgacccccgccggugcaugaagcccgucauccucaccgacggggaggagcgcgugauccuggcgggccccaugccggugacccacagcuccgccgcccagcggcgcgggcggaucggccgcaaccccaagaacgagaacgaccaguacaucuacaugggggagccccuggagaacgacgaggacugcgcccacuggaaggaggccaagaugcuccuggacaacaucaacacgcccgagggcaucaucccgagcauguucgagcccgagcgggagaaggucgacgcgaucgacggcgaguaccgccugcgcggggaggcccggaagaccuucguggaccucaugcgccggggcgaccugcccguguggcuggccuacaaggucgccgccgaggggaucaacuacgcggaccgccgguggugcuucgacggcaucaagaacaaccagauccucgaggagaacguggaggucgagaucuggaccaaggagggggagcgcaagaagcugaagccgcgguggcuggacgcccgcaucuacuccgacccccucgcccugaaggaguucaaggaguucgccgccggccggaagucccugacccucaaccugaucacggagaugggccgccugcccaccuucaugacccagaagacccgggacgcgcucgacaaccuggccgugcugcacacggccgaggccgggggccgcgcguacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgccuccauccuccugugguacgcccagauccagccgcacuggaucgcggccagcaucauccuggaguucuuccucaucguccugcugauccccgagcccgagaagcagcgcacgccccaggacaaccagcucacguacguggugaucgccauccugaccgucguggccgccaccauggcgaacgagaugggcuuccuggagaagaccaagaaggaccucgggcugggcuccaucgccacgcagcagccggagagcaacauccuggacaucgaccuccggcccgccuccgccuggacccuguacgccguggcgaccaccuucgucacgcccaugcugcgccacagcaucgagaacagcuccgugaacgugagccucaccgccaucgccaaccaggccaccguccugaugggccuggggaagggcuggccccucuccaagauggacaucggggugccgcugcuggccaucggcugcuacagccaggugaaccccaucacccucacggcggcccugcugcuccuggucgcccacuacgccaucaucgggcccggccugcaggcgaaggccacccgggaggcccagaagcgcgccgccgcgggcaucaugaagaaccccaccguggacgggaucaccgugaucgaccucgacccgauccccuacgaccccaaguucgagaagcagcugggccaggucaugcugcucauccugugcgugacccaggugcugaugaugcggaccaccugggcccucugcgaggcccugacccuggccacggggcccaucuccacccucugggagggcaacccggggcgcuucuggaacaccaccaucgccgucagcauggcgaacaucuuccggggcuccuaccuggccggcgccgggcuccucuucagcaucaugaagaacacgaccaacacccgccgcggcaccgggaacaucggcgagacgcugggcgagaaguggaagucccggcugaacgcccucggcaagagcgaguuccagaucuacaagaaguccggcauccaggagguggaccgcacccuggccaaggaggggaucaagcggggcgagaccgaccaccacgcggugagccgcggguccgccaagcugcggugguucgucgagcgcaacauggugacccccgagggcaagguggucgaccucggcugcgggcggggcggguggagcuacuacugcggcgggcugaagaacgugcgcgaggugaagggccugacgaagggcgggcccggccacgaggagcccaucccgauguccaccuacggguggaaccucguccggcugcagagcggcguggacguguucuucaucccgcccgagaagugcgacacccugcucugcgacaucggggaguccagccccaacccgaccgucgaggccggccgcacgcugcgggugcugaaccucguggagaacuggcugaacaacaacacccaguucugcaucaagguccugaaccccuacaugcccuccgugaucgagaagauggaggcccugcagcgcaaguacggcggggcgcucgugcggaacccgcugagccgcaacagcacccacgagauguacugggucuccaacgccagcggcaacaucguguccagcgugaacaugaucucccggaugcugaucaaccgcuucaccaugcggcacaagaaggccaccuacgagcccgacgucgaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgccuccagcauggugaacggcgugguccgccugcucaccaagccgugggacgugcugcccaccgugacccagauggcgaugacggacaccacccccuucgggcagcagcgcgucuucaaggagaagguggacacccggacgcaggagcccaaggagggcaccaagaagcugaugaagaucaccgccgaguggcucuggaaggagcugggcaagaagaagaccccgcgcaugugcacgcgggaggaguucacccgcaaggugcgguccaacgccgcccugggggccaucuucaccgacgagaacaaguggaaguccgcgcgcgaggccgucgaggacucccgguucugggagcucguggacaaggagcgcaaccugcaccuggagggcaagugcgagaccugcgucuacaacaugauggggaagcgggagaagaagcucggcgaguucgggaaggccaagggcagccgcgccaucugguacauguggcugggcgcccgguuccuggaguucgaggcgcucggguuccugaacgaggaccacugguucucccgcgagaacagccuguccggcguggagggggagggccuccacaagcugggguacauccugcgggacgugagcaagaaggagggcggcgccauguacgccgacgacacggccgggugggacacccgcaucacccucgaggaccugaagaacgaggagauggucaccaaccacauggagggcgagcacaagaagcuggcggaggccaucuucaagcucacguaccagaacaagguggugcggguccagcgccccacgccccgggggaccgugauggacaucaucagccgccgggaccagcgcggcuccggccaggugggcaccuacggccugaacacguucaccaacauggaggcccagcugauccggcagauggagggggagggcgucuucaagaacauccagcaccucaccgugaccgaggagguggccguccacaacuggcuggcccgcguggggcgcgagcggcugagccgcauggcgaucuccggcgacgacugcguggucaagccccucgacgaccgguucgccaacgcccugacggcccugaacgacaugggcaagauccgcaaggacauccagcagugggagccgagcaagggguggaacgacuggacccaggugcccuucugcucccaccacuuccacgagcucaucaugaaggacggccgggugcuggucgugcccugccgcaaccaggacgagcugaucgggcgggcccgcaucagccagggcgcgggguggucccuccgggagaccgccugccugggcaagagcuacgcccagauguggucccugauguacuuccaccgccgggaccuccgccuggccgccaacgcgaucugcagcgccgugcccucccacugggucccgaccagccggacgaccugguccauccacgccaagcacgaguggaugaccaccgaggacaugcugaccguguggaaccgcguguggauccgggagaaccccuggauggaggacaagacgcccgucgagagcugggaggagauccccuaccucggcaagcgcgaggaccaguggugcgggucccugaucggccugaccagccgggccaccugggccaagaacauccaggcggccaucaaccaggugcgcucccucaucgggaacgaggaguacaccgacuacaugccgagcaugaagcgguuccgccgcgaggaggaggaggccggcgugcugugguga

SEQ ID NO: 9597 - RNA, 9876 nt, Artificial Sequence
  derived and/or modified CDS sequence (opt1) from DENV-2__EU482783__SS-prME
accgccggggugaucaucaugcugauccccaccgccauggcguuccaccucaccacccggaacggggagccccacaugaucgucgggcggcaggagaagggcaagagccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgggaucaagggcaucaugcaggccggcaagcggucccugcgcccccagcccaccgagcugaaguacagcuggaagaccugggggaaggccaagaugcucuccaccgagagccacaaccagacguuccugaucgacggcccggagaccgccgagugccccaacaccaaccgggccuggaacucccuggagguggaggacuacggguucggcguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggucaagagcugccacuggcccaagucccacacccuguggagcaacggggugcuggaguccgagaugaucauccccaagagcuucgccggcccggugucccagcacaacuaccgccccggguacuacacccagaccgccggccccuggcaccucgggaagcuggagauggacuucgacuucugcgagggcacgaccguggucgugaccgaggacugcggcaaccgggggcccagccugcgcaccacgaccgccagcggcaagcucaucaccgaguggugcugccgguccugcacccugccgccccugcgcuaccgcggggaggacggcugcugguacgggauggagauccgcccccucaaggagaaggaggagaaccuggugaacagccuggucacggcgggccacggccagaucgacaacuucucccucggggugcugggcauggcccuguuccucgaggagaugcugcggacccgcguggggaccaagcacgccauccugcucgucaccgugagcuucgugacgcugaucaccggcaacauguccuuccgggaccuggggcgcgucauggugauggugggcgccgccaugaccgacgacaucggcaugggggucaccuaccucgcgcugcuggccgccuucaaggugcgccccacguucgccgccggccuccugcugcggaagcucaccagcaaggagcugaugauggcgaccaucgggaucgcccugcucucccagagcaccaucccggagacgauccuggagcugaccgacgcccucgcccugggcaugauggugcugaagaucguccgcaacauggagaaguaccagcucgccgugaccaucauggcgaucuccugcgugcccaacgccgucauccugcagaacgccuggaaggugagcugcaccauccuggccgcgguguccgucagcccccuccugcugacguccagccagcagaaggccgacuggaucccccucgcccugaccaucaagggccugaacccgaccgccaucuuccucaccacgcugucccggaccagcaagaagcgcuccuggccccugaacgaggccaucauggcgguggggauggucagcauccucgccuccagccugcugaagaacgacauccccaugaccggcccccucguggccgggggccugcugaccgugugcuacguccucacggggcggagcgccgaccuggagcuggagcgcgccaccgacgugaagugggaggaccaggcggagaucuccggcagcuccccgauccucagcaucaccaucgccgaggacggcuccaugagcaucaagaacgaggaggaggagcagacccugacgauccugauccggaccgggcuccuggugaucuccggccuguuccccgucagcauccccaucaccgccgccgccugguaccucugggaggugaagaagcagcgcgcgggggugcugugggacguccccuccccgccgcccgugggcaaggccgagcuggaggacggggccuaccggaucaagcagaagggcauccucggcuacagccagaucggggccggcguguacaaggaggggaccuuccacaccauguggcacgucacgcgcggcgccgugcugaugcaccgggggaagcgcaucgagccguccugggcggacgugaagaaggaccugaucagcuacggcggcggguggaagcucgagggcgaguggaaggagggggaggagguccaggugcuggcccuggagcccggcaagaacccccgggccgugcagaccaagcccggccucuucaagaccaacaccggcacgaucggcgccgucucccuggacuucagcccggggaccuccggcagccccaucguggaccgcaaggggaagguggucggccuguacggcaacgggguggugacccgguccggcgcguacgucagcgccaucgcccagaccgagaaguccaucgaggacaaccccgagaucgaggacgacaucuuccgcaagaagcggcucacgaucauggaccugcaccccggggccggcaagaccaagcgcuaccugccggccaucgugcgggaggcgaucaagcgcgggcugcggacccucauccuggcccccacccgcguggucgccgccgagauggaggaggcccugcgcggccuccccauccgguaccagacgcccgcgauccgcgccgagcacaccggccgggagaucguggaccugaugugccacgccaccuucaccaugcgccugcucagcccggugcggguccccaacuacaaccugaucaucauggacgaggcccacuucacggaccccgccagcaucgcggcccgcggguacaucuccacccggguggagaugggcgaggccgccgggaucuucaugaccgcgacgccgcccggcagccgcgaccccuucccccaguccaacgcccccaucauggacgaggagcgggagauccccgagcgcagcuggaacuccgggcacgagugggugacggacuucaagggcaagaccgucugguucgugcccagcaucaaggccggcaacgacaucgccgccugccugcggaagaacgggaagaaggugauccagcucucccgcaagaccuucgacagcgaguacgucaagacccggacgaacgacugggacuucguggugaccaccgacaucuccgagaugggcgcgaacuucaaggccgagcgcgucaucgacccccggcgcugcaugaagcccgugauccugaccgacggggaggagcgggugauccuggccggcccgaugcccgucacgcacagcuccgccgcccagcgccgggggcgcaucggccgcaaccccaagaacgagaacgaccaguacaucuacaugggcgagccccucgagaacgacgaggacugcgcgcacuggaaggaggccaagaugcugcuggacaacaucaacaccccggaggggaucauccccagcauguucgagcccgagcgggagaagguggacgccaucgacggcgaguaccgccuccgcggggaggcccgcaagaccuucguggaccugaugcggcgcggcgaccugccggucuggcucgccuaccggguggcggccgaggggaucaacuacgccgaccgccgguggugcuucgacggcgugaagaacaaccagauccuggaggagaacgucgagguggagaucuggaccaaggagggcgagcgcaagaagcugaagccccgguggcucgacgcccgcaucuacuccgacccccuggcgcugaaggaguucaaggaguucgccgccgggcgcaagagccucacgcugaaccugaucaccgagaugggccgccuccccaccuucaugacccagaaggcccgggacgcccuggacaaccuggcggugcuccacacggccgaggccgggggccgcgccuacaaccacgcccuguccgagcugccggagacccucgagacccugcugcuccugacccugcucgcgacggucaccggcgggaucuuccuguuccugaugagcggcaagggggugggcaagaugacccucgggaugugcugcaucaucaccgccuccauccugcugugguacgcccagauccagccccacuggaucgccgccagcaucauccucgaguucuuccugaucguccugcucauccccgagcccgagaagcagcggaccccgcaggacaaccagcugacguacguggugaucgcgauccugaccgucguggccgccaccauggccaacgagaugggcuuccucgagaagaccaagaaggaccugggccugggguccaucgccacgcaggagcccgagagcaacauccucgacaucgaccugcgccccgcgagcgccuggacccuguacgccguggccaccaccuucgucacgcccaugcuccggcacuccaucgagaacagcuccgugaacgugagccugaccgcgaucgccaaccaggccaccguccugaugggccucgggaagggcuggccgcuguccaagauggacaucggggugccccugcucgccaucggcugcuacagccaggugaaccccaucacccugacggccgcgcugcuccugcuggucgcccacuacgccaucaucggccccgggcuccaggccaaggccacccgcgaggcgcagaagcgggccgccgccggcaucaugaagaacccgaccguggacgggaucaccgugaucgaccuggaccccauccccuacgaccccaaguucgagaagcagcugggccaggucaugcuccugauccugugcgugacccaggugcucaugaugcgcaccaccugggcccugugcgaggcgcugacccucgccacggggccgaucuccacccugugggagggcaaccccggccgcuucuggaacaccaccaucgccgucagcauggccaacaucuuccggggguccuaccuggcgggcgccgggcuccuguucagcaucaugaagaacacgaccaacacccgccggggcaccggcaacaucggggagacgcugggcgagaaguggaagucccgccucaacgcccugggcaagagcgaguuccagaucuacaagaaguccggcauccaggagguggaccggacccuggccaaggaggggaucaagcgcggcgagaccgaccaccacgccgugagccggggcuccgcgaagcuccgcugguucgucgagcggaacauggugacccccgaggggaagguggucgaccugggcugcgggcgcggcggguggagcuacuacugcggcggccugaaggacgugcgggaggugaaggggcucacgaagggcgggcccggccacgaggagccgauccccauguccaccuacggguggaaccugguccgccugcagagcggcguggacguguucuucacgccgcccgagaagugcgacacccuccugugcgacaucggcgaguccagcccgaaccccacgaucgaggccgggcggacccugcgcguccucagccugguggagaacuggcugaacaacgacacccaguucugcaucaaggugcucaaccccuacaugccguccgucaucgagaagauggagacccugcagcggaaguacggcggggcccuggugcgcaacccccugagccggaacuccacccacgagauguacugggugagcaacgccacgggcaacaucgucuccagcgugaacaugaucucccgcaugcucaucaaccgguucaccaugaagcacaagaaggccaccuacgagcccgacguggaccuggggagcggcacccgcaacaucggcaucgaguccgagauccccaaccuggacaucaucgggaagcgcaucgagaagaucaagcaggagcacgagacgagcuggcacuacgaccaggaccacccguacaagaccugggcguaccacggcuccuacgagaccaagcagaccgggagcgccuccagcauggucaacggcguggugcggcuccugacgaagcccugggacgucgugcccauggugacccagauggccaugaccgacaccacgcccuucggccagcagcgcgucuucaaggagaagguggacacccggacccaggagccgaaggaggggaccaagaagcugaugaagaucacggccgaguggcucuggaaggagcugggcaagaagaagacgccccggaugugcacccgggaggaguucacccgcaaggugcgguccaacgccgcgcugggggccaucuucacggacgagaacaaguggaaguccgcccgcgaggccgucgaggacucccgguucugggagcucguggacaaggagcgcaaccugcaccuggagggcaagugcgagaccugcguguacaacaugauggggaagcgggagaagaagcucggcgaguucggcaaggcgaaggggagccgcgccaucugguacauguggcugggcgcccgguuccuggaguucgaggcccucggguuccugaacgaggaccacugguucucccgcgagaacagccugagcggcgucgagggggagggccuccacaagcugggcuacauccugcgggacguguccaagaaggagggcggggccauguacgcggacgacaccgccgggugggacacccgcaucacgcucgaggaccugaagaacgaggagauggucaccaaccacauggagggcgagcacaagaagcuggccgaggccaucuucaagcucaccuaccagaacaagguggugcggguccagcgccccacgccccgggggacggugauggacaucaucagccgccgggaccagcgcggcuccggccagguggggaccuacggccugaacaccuucaccaacauggaggcccagcugauccgccagauggagggggagggcgucuucaagagcauccagcggcucacggugaccgaggagaucgcggugcagaacuggcuggcccgcgucggccgggagcgccugucccggauggccaucagcggggacgacugcguggugaagccgcucgacgaccgcuucgccuccgcccugaccgcgcugaacgacaugggcaagguccggaaggacauccagcagugggagcccagccgcggguggaacgacuggacccaggugcccuucugcucccaccacuuccacgagcucaucaugaaggacggccgggugcuggucgugcccugccgcaaccaggacgagcugaucgggcgggcccgcaucagccagggcgccggcuggucccucaaggagacggccugccugggcaagagcuacgcccagauguggucccugauguacuuccaccggcgcgaccuccggcuggcggccaacgccaucugcagcgccgugccgucccacuggguccccaccagccgcaccaccugguccauccacgcgaagcacgaguggaugaccacggaggacaugcugaccguguggaaccggguguggauccaggagaaccccuggauggaggacaagacccccgucgagagcugggaggaggugccguaccucggcaagcgcgaggaccaguggugcgggagccugaucggccugaccucccgggccacgugggccaagaacauccagaccgccaucaaccaggugcgcagccucaucgggaacgaggaguacaccgacuacaugcccuccaugaagcgcuuccggcgcgaggaggaggaggccggcguccugugguga

SEQ ID NO: 9598 - RNA, 9876 nt, Artificial Sequence
  derived and/or modified CDS sequence (opt1) from DENV-2__EU482784__SS-prME
agcgcggggaugaucaucaugcugauccccaccgugauggccuuccaccucaccacccggaacggggagccccacaugaucgugggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacauccgcggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacguguucugcgacuccaagcugaugagcgccgccaucaaggacucccgcgccgugcacgcggacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgccggccccgugagccagcacaacuaccggccgggguaccacacccagaccgccggccccuggcaccucgggcgccuggagauggacuucgacuucugcgagggcaccacggucguggugaccgaggacugcgggaaccggggccccagccugcgcaccaccacggcguccggcaagcucaucaccgaguggugcugccggagcugcacccugcccccgcugcgcuaccgcggggaggacggcugcugguacgggauggagauccgcccccucaaggagaaggaggagaaccuggucaacucccuggugaccgccggccacgggcagaucgacaacuucagccucggcgugcugggcauggcccuguuccucgaggagaugcugcggacgcgcaucgggaccaagcacgccauccugcucgucgcgguguccuucgugacccugaucaccggcaacaugagcuuccgggaccuggggcgcgucauggugauggugggcgccacgaugaccgacgacaucgggaugggcgucaccuaccucgcccugcuggccgccuucaaggugcgccccaccuucgcggccggccuccugcugcggaagcucacguccaaggagcugaugaugaccaccaucgggaucgugcugcucagccaguccaccauccccgagacgguccuggagcugaccgacgcccucgcccugggcaugauggugcugaagaucgugcgcaacauggagaaguaccagcucgccgucaccaucauggcgauccugugcgugccgaacgccgucauccugcagaacgccuggaaggugagcugcaccauccucgccguggucuccgugagcccccugcugcucacguccagccagcagaagaccgacuggaucccccuggcccugaccaucaaggggcucaaccccaccgcgaucuuccugacgacccugucccggaccaacaagaagcgcagcuggccgcucaacgaggccaucauggccgugggcauggucuccauccuggccagcucccugcucaagaacgacauccccaugaccggcccccugguggccggcgggcugcucacggugugcuacguccugaccgggcggagcgccgaccuggagcucgagcgcgccaccgacgugaagugggaggaccaggccgagaucagcggguccagccccauccuguccaucaccaucagcgaggacggguccaugagcaucaagaacgaggaggaggagcagacgcugaccauccucauccggaccggccugcuggugaucuccggccucuucccgaucagcauccccaucaccgccgcggccugguaccugugggaggucaagaagcagcgcgccggggugcugugggacgugcccagcccgccgcccaugggcaaggccgagcucgaggacggggccuaccggaucaagcagaagggcauccugggguacagccagaucggcgcgggcgucuacaaggaggggaccuuccacacgauguggcacgugacccgcggcgccgugcugaugcacaaggggaagcggaucgagcccuccugggccgacgucaagaaggaccucaucagcuacggcgggggcuggaagcuggagggcgaguggaaggagggggaggagguccaggugcuggcccucgagcccggcaagaacccccgcgccguccagaccaagcccgggcuguucaagaccaacacgggcaccaucggggcggugucccuggacuucagccccggcaccuccggcagccccaucaucgacaagaaggggaagguggucggccucuacgggaacggcguggugacccgguccggcgccuacgucagcgccaucgcccagacggagaaguccaucgaggacaaccccgagaucgaggacgacaucuuccgcaagcggcgccugaccaucauggaccugcaccccggggccggcaagaccaagcgguaccugcccgcgaucgugcgcgaggccaucaagcgggggcuccgcacccugauccuggccccgacgcggguggucgccgcggagauggaggaggcccuccgcggccugcccauccgcuaccagacccccgccauccgggccgagcacaccgggcgcgagaucguggaccugaugugccacgccaccuucacgaugcggcuccugagccccgugcgcgucccgaacuacaaccugaucaucauggacgaggcgcacuucaccgaccccgccagcaucgccgcccggggcuacaucuccacccgcguggagaugggcgaggccgcggggaucuucaugaccgccacgccgcccggcagccgggacccguucccccaguccaacgcccccaucaucgacgaggagcgcgagauccccgagcggagcuggaacuccgggcacgagugggugaccgacuucaagggcaagaccgucugguucgugccgagcaucaaggccgggaacgacaucgccgcgugccuccgcaagaacggcaagaaggugauccagcugucccggaagaccuucgacagcgaguacgucaagacgcgcaccaacgacugggacuucguggugaccaccgacaucuccgagaugggcgccaacuucaaggccgagcgggucaucgacccccgccggugcaugaagcccgugauccugacggacggggaggagcgcgugauccucgccggccccaugccggucacccacagcuccgcggcccagcggcgcgggcggaucggccgcaaccccaagaacgagaacgaccaguacaucuacaugggggagccccuggagaacgacgaggacugcgcccacuggaaggaggccaagaugcugcucgacaacaucaacacccccgagggcaucaucccgagcauguucgagcccgagcgcgagaagguggacgccaucgacggcgaguaccggcugcgcggggaggcgcggaagaccuucguggaccugaugcgccggggcgaccuccccgucuggcuggccuacaagguggccgccgaggggaucaacuacgccgaccgccgguggugcuucgacggcaucaagaacaaccagauccuggaggagaacguggaggucgagaucuggacgaaggagggggagcgcaagaagcucaagccgcgguggcuggacgcgcgcaucuacuccgacccccuggcccucaaggaguucaaggaguucgccgccggccggaagucccugacccugaaccucaucaccgagaugggccgccugcccaccuucaugacgcagaagacccgggacgcccuggacaaccucgcggugcugcacaccgccgaggccgggggccgcgccuacaaccacgcgcuguccgagcuccccgagacccuggagacgcugcuccugcugacccuccuggccaccgucaccgggggcaucuuccuguuccucaugagcggccgggggaucggcaagaugacccuggggaugugcugcaucaucacggccuccauccugcucugguacgcccagauccagccgcacuggaucgccgcgagcaucauccuggaguucuuccugaucgugcuccugauccccgagcccgagaagcagcgcacgccccaggacaaccagcugaccuacguggucaucgccauccucaccgugguggccgccacgauggccaacgagaugggcuuccuggagaagaccaagaaggaccuggggcucggcuccaucgcgacccagcagccggagagcaacauccuggacaucgaccugcggcccgccagcgccuggacccucuacgccgucgccacgaccuucgugacccccaugcugcgccacuccaucgagaacagcuccgugaacgucagccugaccgcgaucgccaaccaggccacggugcucaugggccuggggaagggcuggccccuguccaagauggacaucggggugccgcuccuggccaucggcugcuacagccaggucaaccccaucacccugaccgccgcgcuccugcugcucguggcccacuacgccaucaucgggcccggccugcaggccaaggcgacccgggaggcccagaagcgcgccgccgccggcaucaugaagaaccccacgguggacgggaucaccgucaucgaccuggacccgauccccuacgaccccaaguucgagaagcagcucggccaggugaugcugcugauccucugcgugacccagguccugaugaugcggaccacgugggcgcugugcgaggcccucacccuggccaccgggcccaucuccacccugugggagggcaacccggggcgcuucuggaacacgaccaucgccgugagcauggccaacaucuuccgcggcuccuaccucgcgggcgccgggcugcuguucagcaucaugaagaacaccaccaacacgcggcgcggcaccgggaacaucggcgagacccucggcgagaaguggaagucccggcugaacgcccugggcaagagcgaguuccagaucuacaagaaguccggcauccaggagguggaccgcacccucgccaaggaggggaucaagcggggcgagacggaccaccacgccgucagccgcggguccgcgaagcugcggugguucguggagcgcaacauggugacccccgagggcaaggucguggaccugggcugcgggcggggcggguggagcuacuacugcggcgggcucaagaacgugcgcgaggucaagggccugaccaagggcgggcccggccacgaggagcccaucccgauguccaccuacggguggaaccuggugcggcuccagagcggcguggacgucuucuucaucccgcccgagaagugcgacacgcugcugugcgacaucggggaguccagccccaacccgaccguggaggccggccgcacccuccgggugcugaaccuggucgagaacuggcucaacaacaacacccaguucugcaucaaggugcugaaccccuacaugcccagcgugaucgagaagauggaggcccugcagcgcaaguacggcggggcccugguccggaacccgcucucccgcaacagcacccacgagauguacuggguguccaacgcgagcggcaacaucguguccagcgucaacaugaucucccggaugcugaucaaccgcuucacgaugcggcacaagaaggccaccuacgagcccgacguggaccuggggagcggcacccgcaacaucgggaucgaguccgagauccccaaccucgacaucaucggcaagcgcaucgagaagaucaagcaggagcacgagaccagcuggcacuacgaccaggaccaccccuacaagacgugggccuaccacggcuccuacgagaccaagcagaccgggagcgccuccagcauggugaacggcgucgugcggcugcugaccaagccgugggacgugcuccccacggucacccagauggccaugaccgacaccacgcccuucgggcagcagcgcguguucaaggagaagguggacacccggacccaggagcccaaggagggcaccaagaagcugaugaagaucacggcggaguggcuguggaaggagcucggcaagaagaagaccccgcgcaugugcacccgggaggaguucacccgcaagguccgguccaacgccgcccugggggccaucuucacggacgagaacaaguggaaguccgcccgcgaggcgguggaggacucccgguucugggagcugguggacaaggagcgcaaccuccaccuggagggcaagugcgagaccugcgucuacaacaugauggggaagcgggagaagaagcugggcgaguucgggaaggccaagggcagccgcgccaucugguacauguggcucggcgcccgguuccuggaguucgaggcccugggguuccucaacgaggaccacugguucucccgcgagaacagccugagcggcguggagggggagggccugcacaagcucggguacauccugcgggacgucuccaagaaggagggcggcgcgauguacgccgacgacaccgccgggugggacacccgcaucacgcuggaggaccucaagaacgaggagauggugaccaaccacauggagggcgagcacaagaagcuggccgaggcgaucuucaagcugaccuaccagaacaaggugguccgggugcagcgccccacgccccgggggacggugauggacaucaucagccgccgggaccagcgcggcuccgggcaggucggcaccuacggccucaacaccuucaccaacauggaggcccagcugauccgccagauggagggggagggcguguucaagaacauccagcaccugacggugaccgaggaggucgccgugcacaacuggcucgcccggguggggcgcgagcggcugagccgcauggccaucuccggcgacgacugcgucgugaagccccuggacgaccgguucgcgaacgcccucaccgcccugaacgacaugggcaagauccgcaaggacauccagcagugggagccgagcaagggguggaacgacuggacccaggugcccuucugcucccaccacuuccacgagcugaucaugaaggacggccggguccucguggugcccugccgcaaccaggacgagcugaucgggcgggcccgcaucagccagggcgccggguggucccugcgggagacggcgugccucggcaagagcuacgcccagauguggucccugauguacuuccaccgccgggaccugcgccucgccgccaacgccaucugcagcgcgguccccucccacugggugccgaccagccggaccaccugguccauccacgccaagcacgaguggaugaccacggaggacaugcugaccguguggaaccgcgucuggauccgggagaaccccuggauggaggacaagacccccguggagagcugggaggagauccccuaccugggcaagcgcgaggaccaguggugcgggucccucaucggccugaccagccgggccacgugggccaagaacauccaggccgcgaucaaccaggugcgcagccugaucgggaacgaggaguacaccgacuacaugccguccaugaagcgcuuccggcgcgaggaggaggaggccggcguccucugguga

SEQ ID NO: 9599 - RNA, 9876 nt, Artificial Sequence
  derived and/or modified CDS sequence (opt1) from DENV-2__EU482785__SS-prME
accgccggggugaucaucaugcugauccccaccgccauggcguuccaccucaccacccggaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacccuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgacaucaaggggaucaugcaggccggcaagcggucccugcgcccccagcccaccgagcugaaguacagcuggaagaccuggggcaaggccaagaugcucuccaccgagagccacaaccagacguuccugaucgacgggccggagaccgccgagugccccaacaccaaccgggccuggaacucccuggagguggaggacuacggcuucgggguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggucaagagcugccacuggcccaagucccacacccuguggagcaacggcgugcuggaguccgagaugaucauccccaagagcuucgccgggccggugucccagcacaacuaccgccccggcuacuacacccagaccgccgggcccuggcaccucggcaagcuggagauggacuucgacuucugcgaggggacgaccguggucgugaccgaggacugcggcaaccggggccccagccugcgcaccacgaccgccagcgggaagcucaucaccgaguggugcugccgguccugcacccugccgccccugcgcuaccggggcgaggacgggugcugguacggcauggagauccgcccccucaaggagaaggaggagaaccuggugaacagccuggucacggcggggcacggccagaucgacaacuucucccucggcgugcuggggauggcccuguuccucgaggagaugcugcggacccgcgugggcaccaagcacgccauccugcucgucaccgugagcuucgugacgcugaucaccgggaacauguccuuccgggaccugggccgcgucauggugauggugggggccgccaugaccgacgacaucggcaugggcgucaccuaccucgcgcugcuggccgccuucaaggugcgccccacguucgccgccgggcuccugcugcggaagcucaccagcaaggagcugaugauggcgaccaucggcaucgcccugcucucccagagcaccaucccggagacgauccuggagcugaccgacgcccucgcccuggggaugauggugcugaagaucguccgcaacauggagaaguaccagcucgccgugaccaucauggcgaucuccugcgugcccaacgccgucauccugcagaacgccuggaaggugagcugcaccauccuggccgcgguguccgucagcccccuccugcugacguccagccagcagaaggccgacuggaucccccucgcccugaccaucaagggccugaacccgaccgccaucuuccucaccacgcugucccggaccagcaagaagcgcuccuggccccugaacgaggccaucauggcggugggcauggucagcauccucgccuccagccugcugaagaacgacauccccaugaccgggccccucguggccggcgggcugcugaccgugugcuacguccucacgggccggagcgccgaccuggagcuggagcgcgccaccgacgugaagugggaggaccaggcggagaucuccgggagcuccccgauccucagcaucaccaucgccgaggacggcuccaugagcaucaagaacgaggaggaggagcagacccugacgauccugauccggaccggccuccuggugaucuccgggcuguuccccgucagcauccccaucaccgccgccgccugguaccucugggaggugaagaagcagcgcgcgggcgugcugugggacguccccuccccgccgcccguggagaaggccgagcuggaggacggggccuaccggaucaagcagaagggcauccucggguacagccagaucggcgccggcguguacaaggaggggaccuuccacaccauguggcacgucacgcgcggcgccgugcugaugcaccgggggaagcgcaucgagccguccugggcggacgugaagaaggaccugaucagcuacggcgggggcuggaagcucgagggcgaguggaaggagggggaggagguccaggugcuggcccuggagcccggcaagaacccccgggccgugcagaccaagcccggccucuucaagaccaacaccggcacgaucggggccgucucccuggacuucagcccgggcaccuccggcagccccaucguggaccgcaaggggaagguggucggccuguacgggaacggcguggugacccgguccggcgcguacgucagcgccaucgcccagaccgagaaguccaucgaggacaaccccgagaucgaggacgacaucuuccgcaagaagcggcucacgaucauggaccugcaccccggggccggcaagaccaagcgcuaccugccggccaucgugcgggaggcgaucaagcgcgggcugcggacccucauccuggcccccacccgcguggucgccgccgagauggaggaggcccugcgcggccuccccauccgguaccagacgcccgcgauccgcgccgagcacaccgggcgggagaucguggaccugaugugccacgccaccuucaccaugcgccugcucagcccggugcggguccccaacuacaaccugaucaucauggacgaggcccacuucacggaccccgccagcaucgcggcccgcggcuacaucuccacccggguggagaugggcgaggccgccgggaucuucaugaccgcgacgccgcccggcagccgcgaccccuucccccaguccaacgcccccaucauggacgaggagcgggagauccccgagcgcagcuggaacuccgggcacgagugggugacggacuucaagggcaagaccgucugguucgugcccagcaucaaggccgggaacgacaucgccgccugccugcggaagaacggcaagaaggugauccagcucucccgcaagaccuucgacagcgaguacgucaagacccggacgaacgacugggacuucguggugaccaccgacaucuccgagaugggcgcgaacuucaaggccgagcgcgucaucgacccccggcgcugcaugaagcccgugauccugaccgacggggaggagcgggugauccuggccggcccgaugcccgucacgcacagcuccgccgcccagcgccgggggcgcaucggccgcaaccccaagaacgagaacgaccaguacaucuacaugggggagccccucgagaacgacgaggacugcgcgcacuggaaggaggccaagaugcugcuggacaacaucaacaccccggagggcaucauccccagcauguucgagcccgagcgggagaagguggacgccaucgacggcgaguaccgccuccgcggggaggcccgcaagaccuucguggaccugaugcggcgcggcgaccugccggucuggcucgccuaccggguggcggccgaggggaucaacuacgccgaccgccgguggugcuucgacggcgugaagaacaaccagauccuggaggagaacgucgagguggagaucuggaccaaggagggggagcgcaagaagcugaagccccgguggcucgacgcccgcaucuacuccgacccccuggcgcugaaggaguucaaggaguucgccgccggccgcaagagccucacgcugaaccugaucaccgagaugggccgccuccccaccuucaugacccagaaggcccgggacgcccuggacaaccuggcggugcuccacacggccgaggccgggggccgcgccuacaaccacgcccuguccgagcugccggagacccucgagacccugcugcuccugacccugcucgcgacggucaccgggggcaucuuccuguuccugaugagcggcaagggggugggcaagaugacccucgggaugugcugcaucaucaccgccuccauccugcugugguacgcccagauccagccccacuggaucgccgccagcaucauccucgaguucuuccugaucguccugcucauccccgagcccgagaagcagcggaccccgcaggacaaccagcugacguacguggugaucgcgauccugaccgucguggccgccaccauggccaacgagaugggcuuccucgagaagaccaagaaggaccuggggcugggcuccaucgccacgcaggagcccgagagcaacauccucgacaucgaccugcgccccgcgagcgccuggacccuguacgccguggccaccaccuucgucacgcccaugcuccggcacuccaucgagaacagcuccgugaacgugagccugaccgcgaucgccaaccaggccaccguccugaugggccucgggaagggcuggccgcuguccaagauggacaucggggugccccugcucgccaucggcugcuacagccaggugaaccccaucacccugacggccgcgcugcuccugcuggucgcccacuacgccaucaucgggcccggccuccaggccaaggccacccgcgaggcgcagaagcgggccgccgccggcaucaugaagaacccgaccguggacggggugaccgucaucgaccuggaccccauccccuacgaccccaaguucgagaagcagcugggccaggugaugcuccugauccugugcgugacgcagguccucaugaugcgcaccaccugggcccugugcgaggcgcugacccucgccacggggccgaucuccacccugugggagggcaaccccgggcgcuucuggaacaccaccaucgccgugagcauggccaacaucuuccggggcuccuaccuggcgggcgccgggcuccuguucagcaucaugaagaacacgaccaacacccgccggggcaccgggaacaucggcgagacgcugggcgagaaguggaagucccgccucaacgcccugggcaagagcgaguuccagaucuacaagaaguccggcauccaggagguggaccggacccuggccaaggaggggaucaagcgcggcgagaccgaccaccacgccgucagccggggguccgcgaagcuccgcugguucguggagcggaacauggugacccccgagggcaaggucguggaccugggcugcgggcgcggcggguggagcuacuacugcggcgggcugaaggacgugcgggaggucaagggccucacgaagggcgggcccggccacgaggagccgauccccauguccaccuacggguggaaccuggugcgccugcagagcggcguggacgucuucuucacgccgcccgagaagugcgacacccuccugugcgacaucggggaguccagcccgaaccccacgaucgaggccggccggacccugcgcgugcucagccugguggagaacuggcugaacaacgacacccaguucugcaucaagguccucaaccccuacaugccguccgugaucgagaagauggagacccugcagcggaaguacggcggggcccuggugcgcaacccccugagccggaacuccacccacgagauguacugggucagcaacgccacgggcaacaucguguccagcgugaacaugaucucccgcaugcucaucaaccgguucaccaugaagcacaagaaggccaccuacgagcccgacgucgaccuggggagcggcacccgcaacaucgggaucgaguccgagauccccaaccuggacaucaucggcaagcgcaucgagaagaucaagcaggagcacgagacgagcuggcacuacgaccaggaccacccguacaagaccugggcguaccacggcuccuacgagaccaagcagaccgggagcgccuccagcauggugaacggcgugguccggcuccugacgaagcccugggacguggugcccauggucacccagauggccaugaccgacaccacgcccuucgggcagcagcgcguguucaaggagaagguggacacccggacccaggagccgaaggagggcaccaagaagcugaugaagaucacggccgaguggcucuggaaggagcugggcaagaagaagacgccccggaugugcacccgggaggaguucacccgcaagguccgguccaacgccgcgcugggggccaucuucacggacgagaacaaguggaaguccgcccgcgaggccguggaggacucccgguucugggagcucguggacaaggagcgcaaccugcaccuggagggcaagugcgagaccugcgucuacaacaugauggggaagcgggagaagaagcucggcgaguucgggaaggcgaagggcagccgcgccaucugguacauguggcugggcgcccgguuccuggaguucgaggcccucggguuccugaacgaggaccacugguucucccgcgagaacagccugagcggcguggagggggagggccuccacaagcugggguacauccugcgggacgucuccaagaaggagggcggcgccauguacgcggacgacaccgccgggugggacacccgcaucacgcucgaggaccugaagaacgaggagauggugaccaaccacauggagggcgagcacaagaagcuggccgaggccaucuucaagcucaccuaccagaacaaggugguccgggugcagcgccccacgccccgggggacggugauggacaucaucagccgccgggaccagcgcggcuccgggcaggucggcaccuacggccugaacaccuucaccaacauggaggcccagcugauccgccagauggagggggagggcguguucaagagcauccagcggcucacggugaccgaggagaucgcgguccagaacuggcuggcccgcguggggcgggagcgccugucccggauggccaucagcggcgacgacugcguggucaagccgcucgacgaccgcuucgccuccgcccugaccgcgcugaacgacaugggcaaggugcggaaggacauccagcagugggagcccagccgcggguggaacgacuggacccaggugcccuucugcucccaccacuuccacgagcucaucaugaaggacggccggguccugguggugcccugccgcaaccaggacgagcugaucgggcgggcccgcaucagccagggcgccggguggucccucaaggagacggccugccugggcaagagcuacgcccagauguggucccugauguacuuccaccggcgcgaccuccggcuggcggccaacgccaucugcagcgccgucccgucccacugggugcccaccagccgcaccaccugguccauccacgcgaagcacgaguggaugaccacggaggacaugcugaccguguggaaccgggucuggauccaggagaaccccuggauggaggacaagacccccguggagagcugggaggaggugccguaccucggcaagcgcgaggaccaguggugcgggagccugaucggccugaccucccgggccacgugggccaagaacauccagaccgccaucaaccagguccgcagccucaucgggaacgaggaguacaccgacuacaugcccuccaugaagcgcuuccggcgcgaggaggaggaggccggcgugcugugguga

SEQ ID NO: 9600 - RNA, 9876 nt, Artificial Sequence
  derived and/or modified CDS sequence (opt1) from DENV-2__EU482786__SS-prME
agcgccggcaugaucaucaugcugauccccaccgugauggccuuccaccucaccacccggaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccggcgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcgggcuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggggaaggacucccccgucaacaucgaggccgagccgcccuucggcgacagcuacaucaucaucgggguggagccgggccagcugaagcucaacugguucaagaagggguccagcaucggccagauguucgagaccaccaugcgcggcgcgaagcgcauggccauccugggggacaccgccugggacuucggcucccucggcgggguguucacgagcaucgggaaggcccuccaccaggucuucggggccaucuacggcgcggccuucuccggggugagcuggaccaugaagauccugaucggcgugaucaucaccuggaucgggaugaacucccggagcaccucccugagcgucucccuggugcucgugggcaucgucacgcuguaccugggggugauggugcaggccgacagcggcugcgucguguccuggaagaacaaggagcucaagugcggcagcgggaucuucaucaccgacaacgugcacaccuggaccgagcaguacaaguuccagcccgagagccccuccaagcuggccagcgcgauccagaaggcccaggaggagggcaucugcgggauccgcuccgucacgcggcuggagaaccucauguggaagcagaucacccccgagcugaaccacauccuggccgagaacgaggugaagcucaccaucaugaccggcgacaucaaggggaucaugcaggccggcaagcgcagccugcggccgcagcccacggagcugaaguacuccuggaagaccuggggcaaggccaagaugcucagcaccgaguccuacaaccagaccuuccugaucgacgggcccgagacggcggagugcccgaacaccaaccgcgccuggaacagccuggagguggaggacuacggcuucggggucuucaccaccaacaucuggcucaagcugaaggagaagcaggacgccuucugcgacuccaagcugaugagcgccgccaucaaggacaaccgggcggugcacgccgacaugggcuacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccgggcccgugagccagcacaacuaccgcccgggcuaccacacccagaucgcggggcccuggcaccugggcaagcuggagauggacuucgacuucugcgacgggaccaccgugaucgucacggaggacugcggcaaccggggccccucccuccgcaccaccaccgccagcgggaagcugaucacggaguggugcugccggagcugcacccugcccccgcuccgcuaccggggcgaggacgggugcugguacggcauggagauccgcccccugaaggagaaggaggagaaccuggugaacucccucgugaccgccgggcacggccaggucgacaacuucagccugggcgugcuggggauggcccucuuccuggaggagaugcugcggacccgcgugggcacgaagcacgcgauccuccuggucgccguguccuucgugacccugaucaccgggaacaugagcuucaaggaccucggccgggucguggugauggucggggccaccauggccgacgacaucggcaugggcgugacguaccuggcccugcucgcggccuucaaggugcgccccaccuucgccgccgggcugcugcuccggaagcugaccuccaaggagcugaugaugaccacgaucggcaucguccuccugagccaguccaccauccccgagaccgugcuggagcucaccgacgcccuggcgcuggggaugauggugcucaagaucguccgcaacauggagaaguaccagcuggccgugacgaucauggccauccugugcgucccgaacgccguggugcuccagaacgccuggaaggucagcugcaccauccuggcggugguguccgucagcccccugcuccugaccuccagccagcagaagaccgacuggaucccccuggcccucacgaucaagggccugaaccccaccgccaucuuccugaccacccucucccgcacgaacaagaagcggagcuggccgcugaacgaggccaucauggcggugggcaugguguccauccuggccagcucccuccugaagaacgacauccccaugaccgggccccuggucgccggcgggcuccugaccgugugcuacgugcugaccggccgcagcgccgaccucgagcuggagcgggccacggacgucaagugggaggaccaggcggagaucuccgggagcagccccauccuguccaucaccaucagcgaggacggcuccaugagcaucaagaacgaggaggaggagcagacccucaccauccugauccgcacgggccugcucgugaucuccgggcuguucccgaucagcauccccaucaccgccgccgccugguaccugugggaggugaagaagcagcgggccggcguccucugggacgugcccagcccgccgcccauggggaaggcggagcuggaggacggcgccuaccgcaucaagcagaaggggauccugggcuacagccagaucggcgccgggguguacaaggagggcaccuuccacaccauguggcacgucacccgcggggcggugcucaugcacaagggcaagcgcaucgagcccuccugggccgacgugaagaaggaccugaucagcuacgggggcggcuggaagcuggagggggaguggaaggagggcgaggagguccaggugcucgcgcuggagcccgggaagaacccccgggccgugcagacgaagcccggccuguucaagaccaacaccgggaccaucggcgccgucucccucgacuucagccccggcacguccgggagccccaucaucgacaagaagggcaaggugguggggcuguacggcaacggcgucgugacccgcuccggggccuacgugagcgccaucgcgcagaccgagaaguccaucgaggacaaccccgagaucgaggacgacaucuuccggaagcgccggcugaccaucauggaccugcaccccggcgccgggaagacgaagcgcuaccuccccgccaucguccgggaggccaucaagcgcggccugcggacccugauccucgcgccgacccgcgugguggccgccgagauggaggaggcccugcgggggcugcccauccgcuaccagacccccgccaucaaggcggagcacacgggccgggagaucgucgaccucaugugccacgccaccuucaccaugcgccugcugagccccgugcgcgugccgaacuacaaccucaucaucauggacgaggcccacuucaccgaccccgccuccaucgccgcgcggggcuacaucagcacgcgcgucgagaugggggaggccgccggcaucuucaugaccgccacgccgcccgggagccgggacccguucccccaguccaacgcccccaucaucgacgaggagcgcgagauccccgagcggagcuggaacuccggccacgagugggugaccgacuucaaggggaagacggugugguucgucccgagcaucaaggcgggcaacgacaucgccgccugccugcgcaagaacggcaagaaggugauccagcugucccggaagaccuucgacagcgaguacgugaagacccgcaccaacgacugggacuucgucgugacgaccgacaucuccgagaugggggccaacuucaaggcggagcgggugaucgacccccgccggugcaugaagcccgucauccucaccgacggcgaggagcgcgugauccuggccgggcccaugccggugacccacagcuccgccgcccagcggcgcggccggaucgggcgcaaccccaagaacgagaacgaccaguacaucuacaugggcgagccccuggagaacgacggcgacugcgcccacuggaaggaggcgaagaugcuccuggacaacaucaacacgcccgaggggaucaucccgagcauguucgagcccgagcgggagaaggucgacgccaucgacggcgaguaccgccugcgcggggaggcccgcaagaccuucguggaccucaugcgccggggcgaccugcccguguggcuggccuacaaggucgccgcggaggggaucaacuacgccgaccgccgguggugcuucgacggcaucaagaacaaccagauccucgaggagaacguggaggucgagaucuggaccaaggagggcgagcgcaagaagcugaagccgcgguggcuggacgcccgcaucuacuccgacccccucgcccugaaggaguucaaggaguucgccgcggggcggaagucccugacccucaaccugaucacggagaugggccgccugcccaccuucaugacccagaagacccgggacgcccucgacaaccuggccgugcugcacacggccgaggccggcgggcgcgccuacaaccacgcccucuccgagcugcccgagacccuggagacccuccugcugcucacccugcuggccacggugaccggcgggaucuuccucuuccugaugagcgggcgggggaucggcaagaugacccuggggaugugcugcaucaucaccgccuccauccuccugugguacgcgcagauccagccgcacuggaucgccgccagcaucauccuggaguucuuccucaucguccugcugauccccgagcccgagaagcagcgcacgccccaggacaaccagcucacguacguggugaucgccauccugaccgucguggccgcgaccauggccaacgagaugggcuuccuggagaagaccaagaaggaccucggccugggguccaucgccacgcagcagccggagagcaacauccuggacaucgaccuccggcccgccuccgccuggacccuguacgcgguggccaccaccuucgucacgcccaugcugcgccacagcaucgagaacagcuccgugaacgugagccucaccgccaucgccaaccaggccaccguccugaugggccuggggaagggcuggccccucuccaagauggacaucggggugccgcugcuggcgaucggcugcuacagccaggugaaccccaucacccucacggccgcccugcugcuccuggucgcccacuacgcgaucaucggccccgggcugcaggccaaggccacccgggaggcccagaagcgcgccgcggccggcaucaugaagaaccccaccguggacgggaucaccgugaucgaccucgacccgauccccuacgaccccaaguucgagaagcagcugggccaggucaugcugcucauccugugcgugacccaggugcugaugaugcggaccaccugggcccucugcgaggcccugacccuggccacggggcccaucuccacccucugggagggcaacccgggccgcuucuggaacaccaccaucgcggucagcauggccaacaucuuccggggguccuaccuggccggcgccgggcuccuguucagcaucaugaagaacacgaccaacacccgccggggcaccggcaacaucggggagacgcugggcgagaaguggaagucccgccugaacgcccucggcaagagcgaguuccagaucuacaagaaguccggcauccaggagguggaccgcacccuggcgaaggaggggaucaagcggggcgagaccgaccaccacgccgugagccgcggcuccgccaagcugcggugguucgucgagcgcaacauggugacccccgaggggaagguggucgaccucggcugcgggcggggcggguggagcuacuacugcggcggccugaagaacgugcgcgaggugaaggggcugacgaagggcgggcccggccacgaggagcccaucccgauguccaccuacggguggaaccucguccggcugcagagcggcguggacguguucuucaucccgcccgagaagugcgacacccugcucugcgacaucggcgaguccagccccaacccgaccgucgaggccgggcgcacgcugcgggugcugaaccucguggagaacuggcugaacaacaacacccaguucugcaucaagguccugaaccccuacaugcccuccgugaucgagaagauggaggcgcugcagcgcaaguacggcggggcccucgugcggaacccgcugagccgcaacagcacccacgagauguacugggucuccaacgccagcggcaacaucguguccagcgugaacaugaucucccggaugcugaucaaccgcuucaccaugcggcacaagaaggccaccuacgagcccgacgucgaccucgggagcggcacgcgcaacaucggcaucgaguccgagauccccaaccuggacaucaucgggaagcggaucgagaagaucaagcaggagcacgagaccagcuggcacuacgaccaggaccaccccuacaagaccugggccuaccacggcuccuacgagaccaagcagacggggagcgcguccagcauggugaacggcgugguccgccugcucaccaagccgugggacgugcugcccaccgugacccagauggccaugacggacaccacccccuucggccagcagcgggucuucaaggagaagguggacacccgcacgcaggagcccaaggaggggaccaagaagcugaugaagaucaccgccaaguggcucuggaaggagcugggcaagaagaagaccccgcgcaugugcacgcgggaggaguucacccgcaaggugcgguccaacgccgcccugggggcgaucuucaccgacgagaacaaguggaaguccgcccgcgaggccgucgaggacucccgguucugggagcucguggacaaggagcgcaaccugcaccuggagggcaagugcgagaccugcgucuacaacaugauggggaagcgggagaagaagcucggcgaguucggcaaggccaaggggagccgcgccaucugguacauguggcugggcgcgcgguuccuggaguucgaggcccucggguuccugaacgaggaccacugguucucccgcgagaacagccuguccggcguggagggggagggccuccacaagcugggcuacauccugcgggacgugagcaagaaggagggcggggccauguacgccgacgacacggcggggugggacacccgcaucacccucgaggaccugaagaacgaggagauggucaccaaccacauggagggcgagcacaagaagcuggccgaggccaucuucaagcucacguaccagaacaagguggugcggguccagcgccccacgccccgggggaccgugauggacaucaucagccgccgggaccagcgcggcuccggccagguggggaccuacggccugaacacguucaccaacauggaggcccagcugauccggcagauggagggggagggcgucuucaagaacauccagcaccucaccgugaccgaggagguggccguccagaacuggcuggcgcgcgugggccgggagcgccugagccgcauggccaucuccggggacgacugcguggucaagccccucgacgaccgguucgccaacgcccugacggcccugaacgacaugggcaagauccgcaaggacauccagcagugggagccgagcaagggguggaacgacuggacccaggugcccuucugcucccaccacuuccacgagcucaucaugaaggacggccgggugcuggucgugcccugccgcaaccaggacgagcugaucgggcgggcgcgcaucagccagggcgccggcuggucccuccgggagaccgccugccugggcaagagcuacgcccagauguggucccugauguacuuccaccgccgggaccuccgccuggccgcgaacgccaucugcagcgccgugcccucccacugggucccgaccagccggacgaccugguccauccacgccaagcacgaguggaugaccaccgaggacaugcugaccguguggaaccgcguguggauccgggagaaccccuggauggaggacaagacgcccgucgagagcugggaggagauccccuaccucggcaagcgcgaggaccaguggugcgggucccugaucggccugaccagccgggccaccugggcgaagaacauccaggccgccaucaaccaggugcgcucccucaucgggaacgaggaguacaccgacuacaugccgagcaugaagcgguuccgccgggaggaggaggaggccggcgugcugugguga

SEQ ID NO: 9601 - RNA, 9876 nt, Artificial Sequence
  derived and/or modified CDS sequence (opt1) from DENV-2__EU482787__SS-prME
accgccggcgugaucaucaugcugauccccaccgccauggcguuccaccucaccacccgcaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucagcaaccgggacuucguggagggcgucagcgggggcuccuggguggacaucgugcucgagcacgggagcugcgucaccaccauggccaagaacaagcccacccuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgacaucaaggggaucaugcaggccggcaagcggucccugcgcccccagcccaccgagcugaaguacagcuggaagaccuggggcaaggccaagaugcucuccaccgagagccacaaccagacguuccugaucgacgggccggagaccgccgagugccccaacaccaaccgggccuggaacucccuggagguggaggacuacggcuucgggguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggucaagagcugccacuggcccaagucccacacccuguggagcaacggcgugcuggaguccgagaugaucauccccaagagcuucgccgggccggugucccagcacaacuaccgccccggcuacuacacccagaccgccgggcccuggcaccucggcaagcuggagauggacuucgacuucugcgaggggacgaccguggucgugaccgaggacugcggcaaccggggccccagccugcgcaccacgaccgccagcgggaagcucaucaccgaguggugcugccgguccugcacccugccgccccugcgcuaccggggcgaggacgggugcugguacggcauggagauccgcccccucaaggagaaggaggagaaccuggugaacagccuggucacggcggggcacggccagaucgacaacuucucccucggcgugcuggggauggcccuguuccucgaggagaugcugcggacccgcgugggcaccaagcacgccauccugcucgucaccgugagcuucgugacgcugaucaccgggaacauguccuuccgggaccugggccgcgucauggugauggugggggccgccaugaccgacgacaucggcaugggcgucaccuaccucgcgcugcuggccgccuucaaggugcgccccacguucgccgccgggcuccugcugcggaagcucaccagcaaggagcugaugauggcgaccaucggcaucgcccugcucucccagagcaccaucccggagacgauccuggagcugaccgacgcccucgcccuggggaugauggugcugaagaucguccgcaacauggagaaguaccagcucgccgugaccaucauggcgaucuccugcgugcccaacgccgucauccugcagaacgccuggaaggugagcugcaccauccuggccgcgguguccgucagcccccuccugcugacguccagccagcagaaggccgacuggaucccccucgcccugaccaucaagggccugaacccgaccgccaucuuccucaccacgcugucccggaccagcaagaagcgcuccuggccccugaacgaggccaucauggcggugggcauggucagcauccucgccuccagccugcugaagaacgacauccccaugaccgggccccucguggccggcgggcugcugaccgugugcuacguccucacgggccggagcgccgaccuggagcuggagcgcgccaccgacgugaagugggaggaccaggcggagaucuccgggagcuccccgauccucagcaucaccaucgccgaggacggcuccaugagcaucaagaacgaggaggaggagcagacccugacgauccugauccggaccggccuccuggugaucuccgggcuguuccccgucagcauccccaucaccgccgccgccugguaccucugggaggugaagaagcagcgcgcgggcgugcugugggacguccccuccccgccgcccguggggaaggccgagcuggaggacggcgccuaccggaucaagcagaaggggauccucggcuacagccagaucggcgccgggguguacaaggagggcaccuuccacaccauguggcacgucacgcgcggggccgugcugaugcaccggggcaagcgcaucgagccguccugggcggacgugaagaaggaccugaucagcuacgggggcggcuggaagcucgagggggaguggaaggagggcgaggagguccaggugcuggcccuggagcccgggaagaacccccgggccgugcagaccaagcccggccucuucaagaccuccaccgggacgaucggcgccgucagccuggacuucuccccgggcaccagcgggucccccaucguggaccgcaagggcaagguggucgggcuguacggcaacggcguggugacccggagcggggcguacgucuccgccaucgcccagaccgagaaguccaucgaggacaaccccgagaucgaggacgacaucuuccgcaagaagcggcucacgaucauggaccugcaccccggcgccgggaagaccaagcgcuaccugccggccaucgugcgggaggcgaucaagcgcggccugcggacccucauccuggcccccacccgcguggucgccgccgagauggaggaggcccugcgcgggcuccccauccgguaccagacgcccgcgauccgcgccgagcacaccggccgggagaucguggaccugaugugccacgccaccuucaccaugcgccugcucagcccggugcggguccccaacuacaaccugaucaucauggacgaggcccacuucacggaccccgccuccaucgcggcccgcggcuacaucagcacccggguggagaugggggaggccgccggcaucuucaugaccgcgacgccgcccgggucccgcgaccccuucccccagagcaacgcccccaucauggacgaggagcgggagauccccgagcgcuccuggaacagcggccacgagugggugacggacuucaaggggaagaccgucugguucgugcccuccaucaaggccggcaacgacaucgccgccugccugcggaagaacggcaagaaggugauccagcucagccgcaagaccuucgacuccgaguacgucaagacccggacgaacgacugggacuucguggugaccaccgacaucagcgagaugggggcgaacuucaaggccgagcgcgucaucgacccccggcgcugcaugaagcccgugauccugaccgacggcgaggagcgggugauccuggccgggccgaugcccgucacgcacuccagcgccgcccagcgccggggccgcaucgggcgcaaccccaagaacgagaacgaccaguacaucuacaugggcgagccccucgagaacgacgaggacugcgcgcacuggaaggaggccaagaugcugcuggacaacaucaacaccccggagggcaucauccccuccauguucgagcccgagcgggagaagguggacgccaucgacggggaguaccgccuccggggcgaggcccgcaagaccuucguggaccugaugcggcgcggggaccugccggucuggcucgccuaccggguggcggccgagggcaucaacuacgccgaccgccgguggugcuucgacggggugaagaacaaccagauccuggaggagaacgucgagguggagaucuggaccaaggagggcgagcgcaagaagcugaagccccgguggcucgacgcccgcaucuacagcgacccccuggcgcugaaggaguucaaggaguucgccgccggccggaagucccucacgcugaaccugaucaccgagauggggcgccuccccaccuucaugacccagaaggcccgggacgcccuggacaaccuggcggugcuccacacggccgaggccggcgggcgcgccuacaaccacgcccugagcgagcugccggagacccucgagacccugcugcuccugacccugcucgcgacggucaccggcggcaucuuccuguuccugauguccgggaagggcguggggaagaugacccucggcaugugcugcaucaucaccgccagcauccugcugugguacgcccagauccagccccacuggaucgccgccuccaucauccucgaguucuuccugaucguccugcucauccccgagcccgagaagcagcggaccccgcaggacaaccagcugacguacguggugaucgcgauccugaccgucguggccgccaccauggccaacgagaugggguuccucgagaagaccaagaaggaccugggccugggcagcaucgccacgcaggagcccgagagcaacauccucgacaucgaccugcgccccgcguccgccuggacccuguacgccguggccaccaccuucgucacgcccaugcuccggcacagcaucgagaacuccagcgugaacgugucccugaccgcgaucgccaaccaggccaccguccugauggggcucggcaagggguggccgcugagcaagauggacaucggcgugccccugcucgccaucgggugcuacucccaggugaaccccaucacccugacggccgcgcugcuccugcuggucgcccacuacgccaucaucggccccggccuccaggccaaggccacccgcgaggcgcagaagcgggccgccgccgggaucaugaagaacccgaccguggacggcgugaccgucaucgaccuggaccccauccccuacgaccccaaguucgagaagcagcugggccaggugaugcuccugauccugugcgugacgcagguccucaugaugcgcaccaccugggcccugugcgaggcgcugacccucgccacgggcccgaucagcacccugugggaggggaaccccggccgcuucuggaacaccaccaucgccguguccauggccaacaucuuccggggcagcuaccuggcgggggccggccuccuguucuccaucaugaagaacacgaccaacacccgccgggggaccggcaacaucggcgagacgcugggggagaaguggaagucccgccucaacgcccugggcaaguccgaguuccagaucuacaagaaguccgggauccaggagguggaccggacccuggccaaggagggcaucaagcgcggggagaccgaccaccacgccgucucccggggcagcgcgaagcuccgcugguucguggagcggaacauggugacccccgagggcaaggucguggaccuggggugcggccgcgggggcugguccuacuacugcgggggccugaaggacgugcgggaggucaagggccucacgaagggcgggcccgggcacgaggagccgauccccaugagcaccuacggcuggaaccuggugcgccugcaguccgggguggacgucuucuucacgccgcccgagaagugcgacacccuccugugcgacaucggcgagagcagcccgaaccccacgaucgaggccggccggacccugcgcgugcucucccugguggagaacuggcugaacaacgacacccaguucugcaucaagguccucaaccccuacaugccgagcgugaucgagaagauggagacccugcagcggaaguacgggggcgcccuggugcgcaacccccugucccggaacagcacccacgagauguacugggucuccaacgccacggggaacaucgugagcuccgugaacaugaucagccgcaugcucaucaaccgguucaccaugaagcacaagaaggccaccuacgagcccgacgucgaccugggcuccgggacccgcaacaucggcaucgagagcgagauccccaaccuggacaucaucggcaagcgcaucgagaagaucaagcaggagcacgagacguccuggcacuacgaccaggaccacccguacaagaccugggcguaccacgggagcuacgagaccaagcagaccggcuccgccagcuccauggugaacggggugguccggcuccugacgaagcccugggacguggugcccauggucacccagauggccaugaccgacaccacgcccuucggccagcagcgcguguucaaggagaagguggacacccggacccaggagccgaaggagggcaccaagaagcugaugaagaucacggccgaguggcucuggaaggagcuggggaagaagaagacgccccgcaugugcacccgggaggaguucacccgcaagguccggagcaacgccgcgcugggcgccaucuucacggacgagaacaaguggaaguccgcccgcgaggccguggaggacagccgguucugggagcucguggacaaggagcgcaaccugcaccuggaggggaagugcgagaccugcgucuacaacaugaugggcaagcgggagaagaagcucggggaguucggcaaggcgaagggcucccgcgccaucugguacauguggcugggggcccgguuccuggaguucgaggcccucggcuuccugaacgaggaccacugguucagccgcgagaacagccuguccgggguggagggcgaggggcuccacaagcugggcuacauccugcgggacgucagcaagaaggagggcggggccauguacgcggacgacaccgccggcugggacacccgcaucacgcucgaggaccugaagaacgaggagauggugaccaaccacauggagggggagcacaagaagcuggccgaggccaucuucaagcucaccuaccagaacaaggugguccgggugcagcgccccacgccccggggcacggugauggacaucaucucccgccgggaccagcgcgggagcggccaggucggcaccuacgggcugaacaccuucaccaacauggaggcccagcugauccgccagauggagggcgaggggguguucaaguccauccagcggcucacggugaccgaggagaucgcgguccagaacuggcuggcccgcgugggccgggagcgccugagccggauggccaucuccggcgacgacugcguggucaagccgcucgacgaccgcuucgccagcgcccugaccgcgcugaacgacauggggaaggugcggaaggacauccagcagugggagcccucccgcggcuggaacgacuggacccaggugcccuucugcagccaccacuuccacgagcucaucaugaaggacgggcggguccugguggugcccugccgcaaccaggacgagcugaucggccgggcccgcaucucccagggggccggcuggagccucaaggagacggccugccugggcaaguccuacgcccagauguggagccugauguacuuccaccggcgcgaccuccggcuggcggccaacgccaucugcuccgccgucccgagccacugggugcccaccucccgcaccaccuggagcauccacgcgaagcacgaguggaugaccacggaggacaugcugaccguguggaaccgggucuggauccaggagaaccccuggauggaggacaagacccccguggagagcugggaggaggugccguaccucgggaagcgcgaggaccaguggugcggcucccugaucgggcugaccagccgggccacgugggccaagaacauccagaccgccaucaaccagguccgcucccucaucggcaacgaggaguacaccgacuacaugcccagcaugaagcgcuuccggcgcgaggaggaggaggccggggugcugugguga

SEQ ID NO: 9602 - RNA, 9876 nt, Artificial Sequence
  derived and/or modified CDS sequence (opt1) from DENV-2__EU482788__SS-prME
accgccggcgugaucaucaugcugauccccaccgccauggcguuccaccucaccacccgcaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgacaucaaggggaucaugcaggccggcaagcggucccugcgcccccagcccaccgagcugaaguacagcuggaagaccuggggcaaggccaagaugcucuccaccgagagccacaaccagacguuccugaucgacgggccggagaccgccgagugccccaacaccaaccgggccuggaacucccuggagguggaggacuacggcuucgggguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggucaagagcugccacuggcccaagucccacacccuguggagcaacggcgugcuggaguccgagaugaucauccccaagagcuucgccgggccggugucccagcacaacuaccgccccggcuacuacacccagaccgccgggcccuggcaccucggcaagcuggagauggacuucgacuucugcgaggggacgaccguggucgugaccgaggacugcggcaaccggggccccagccugcgcaccacgaccgccagcgggaagcucaucaccgaguggugcugccgguccugcacccugccgccccugcgcuaccggggcgaggacgggugcugguacggcauggagauccgcccccucaaggagaaggaggagaaccuggugaacagccuggucacggcggggcacggccagaucgacaacuucucccucggcgugcuggggauggcccuguuccucgaggagaugcugcggacccgcgugggcaccaagcacgccauccugcucgucaccgugagcuucgugacgcugaucaccgggaacauguccuuccgggaccugggccgcgucauggugauggugggggccgccaugaccgacgacaucggcaugggcgucaccuaccucgcgcugcuggccgccuucaaggugcgccccacguucgccgccgggcuccugcugcggaagcucaccagcaaggagcugaugauggcgaccaucggcaucgcccugcucucccagagcaccaucccggagacgauccuggagcugaccgacgcccucgcccuggggaugauggugcugaagaucguccgcaacauggagaaguaccagcucgccgugaccaucauggcgaucuccugcgugcccaacgccgucauccugcagaacgccuggaaggugagcugcaccauccuggccgcgguguccgucagcccccuccugcugacguccagccagcagaaggccgacuggaucccccucgcccugaccaucaagggccugaacccgaccgccaucuuccucaccacgcugucccggaccagcaagaagcgcuccuggccccugaacgaggccaucauggcggugggcauggucagcauccucgccuccagccugcugaagaacgacauccccaugaccgggccccucguggccggcgggcugcugaccgugugcuacguccucacgggccggagcgccgaccuggagcuggagcgcgccaccgacgugaagugggaggaccaggcggagaucuccgggagcuccccgauccucagcaucaccaucgccgaggacggcuccaugagcaucaagaacgaggaggaggagcagacccugacgauccugauccggaccggccuccuggugaucuccgggcuguuccccgucagcauccccaucaccgccgccgccugguaccucugggaggugaagaagcagcgcgcgggcgugcugugggacguccccuccccgccgcccguggggaaggccgagcuggaggacggcgccuaccggaucaagcagaaggggauccucggcuacagccagaucggcgccgggguguacaaggagggcaccuuccacaccauguggcacgucacgcgcggggccgugcugaugcaccggggcaagcgcaucgagccguccugggcggacgugaagaaggaccugaucagcuacgggggcggcuggaagcucgagggggaguggaaggagggcgaggagguccaggugcuggcccuggagcccgggaagaacccccgggccgugcagaccaagcccggccucuucaagaccaacaccgggacgaucggcgccgucucccuggacuucagcccgggcaccuccgggagccccaucguggaccgcaagggcaagguggucgggcuguacggcaacggcguggugacccgguccggggcguacgucagcgccaucgcccagaccgagaaguccaucgaggacaaccccgagaucgaggacgacaucuuccgcaagaagcggcucacgaucauggaccugcaccccggcgccgggaagaccaagcgcuaccugccggccaucgugcgggaggcgaucaagcgcggccugcggacccucauccuggcccccacccgcguggucgccgccgagauggaggaggcccugcgcgggcuccccauccgguaccagacgcccgcgauccgcgccgagcacaccggccgggagaucguggaccugaugugccacgccaccuucaccaugcgccugcucagcccggugcggguccccaacuacaaccugaucaucauggacgaggcccacuucacggaccccgccagcaucgcggcccgcggcuacaucuccacccggguggagaugggggaggccgccggcaucuucaugaccgcgacgccgcccgggagccgcgaccccuucccccaguccaacgcccccaucauggacgaggagcgggagauccccgagcgcagcuggaacuccggccacgagugggugacggacuucaaggggaagaccgucugguucgugcccagcaucaaggccggcaacgacaucgccgccugccugcggaagaacggcaagaaggugauccagcucucccgcaagaccuucgacagcgaguacgucaagacccggacgaacgacugggacuucguggugaccaccgacaucuccgagaugggggcgaacuucaaggccgagcgcgucaucgacccccggcgcugcaugaagcccgugauccugaccgacggcgaggagcgggugauccuggccgggccgaugcccgucacgcacagcuccgccgcccagcgccggggccgcaucgggcgcaaccccaagaacgagaacgaccaguacaucuacaugggcgagccccucgagaacgacgaggacugcgcgcacuggaaggaggccaagaugcugcuggacaacaucaacaccccggagggcaucauccccagcauguucgagcccgagcgggagaagguggacgccaucgacggggaguaccgccuccggggcgaggcccgcaagaccuucguggaccugaugcggcgcggggaccugccggucuggcucgccuaccggguggcggccgagggcaucaacuacgccgaccgccgguggugcuucgacggggugaagaacaaccagauccuggaggagaacgucgagguggagaucuggaccaaggagggcgagcgcaagaagcugaagccccgguggcucgacgcccgcaucuacuccgacccccuggcgcugaaggaguucaaggaguucgccgccggccgcaagagccucacgcugaaccugaucaccgagauggggcgccuccccaccuucaugacccagaaggcccggaacgcccuggacaaccuggcggugcuccacacggccgaggccggcgggcgcgccuacaaccacgcccuguccgagcugccggagacccucgagacccugcugcuccugacccugcucgcgacggucaccggcggcaucuuccuguuccugaugagcgggaagggcguggggaagaugacccucggcaugugcugcaucaucaccgccuccauccugcugugguacgcccagauccagccccacuggaucgccgccagcaucauccucgaguucuuccugaucguccugcucauccccgagcccgagaagcagcggaccccgcaggacaaccagcugacguacguggugaucgcgauccugaccgucguggccgccaccauggccaacgagaugggguuccucgagaagaccaagaaggaccugggccugggcuccaucgccacgcaggagcccgagagcaacauccucgacaucgaccugcgccccgcgagcgccuggacccuguacgccguggccaccaccuucgucacgcccaugcuccggcacuccaucgagaacagcuccgugaacgugagccugaccgcgaucgccaaccaggccaccguccugauggggcucggcaagggguggccgcuguccaagauggacaucggcgugccccugcucgccaucgggugcuacagccaggugaaccccaucacccugacggccgcgcugcuccugcuggucgcccacuacgccaucaucggccccggccuccaggccaaggccacccgcgaggcgcagaagcgggccgccgccgggaucaugaagaacccgaccguggacggcaucaccgugaucgaccuggaccccauccccuacgaccccaaguucgagaagcagcuggggcaggucaugcuccugauccugugcgugacccaggugcucaugaugcgcaccaccugggcccugugcgaggcgcugacccucgccacgggcccgaucuccacccugugggaggggaaccccggccgcuucuggaacaccaccaucgccgucagcauggccaacaucuuccggggcuccuaccuggcgggggccggccuccuguucagcaucaugaagaacacgaccaacacccgccgggggaccggcaacaucggcgagacgcugggggagaaguggaagucccgccucaacgcccugggcaagagcgaguuccagaucuacaagaaguccgggauccaggagguggaccggacccuggccaaggagggcaucaagcgcggggagaccgaccaccacgccgugagccggggcuccgcgaagcuccgcugguucgucgagcggaacauggugacccccgagggcaagguggucgaccuggggugcggccgcgggggcuggagcuacuacugcgggggccugaaggacgugcgggaggugaagggccucacgaagggcggccccgggcacgaggagccgauccccauguccaccuacggcuggaaccugguccgccugcagagcgggguggacguguucuucacgccgcccgagaagugcgacacccuccugugcgacaucggcgaguccagcccgaaccccacgaucgaggccggccggacccugcgcguccucagccugguggagaacuggcugaacaacgacacccaguucugcaucaaggugcucaaccccuacaugccguccgucaucgagaagauggagacccugcagcggaaguacgggggcgcccuggugcgcaacccccugagccggaacuccacccacgagauguacugggugagcaacgccacggggaacaucgucuccagcgugaacaugaucucccgcaugcucaucaaccgguucaccaugaagcacaagaaggccaccuacgagcccgacguggaccugggcagcgggacccgcaacaucggcaucgaguccgagauccccaaccuggacaucaucggcaagcgcaucgagaagaucaagcaggagcacgagacgagcuggcacuacgaccaggaccacccguacaagaccugggcguaccacggguccuacgagaccaagcagaccggcagcgccuccagcauggucaacgggguggugcggcuccugacgaagcccugggacgucgugcccauggugacccagauggccaugaccgacaccacgcccuucggccagcagcgcgucuucaaggagaagguggacacccggacccaggagccgaaggagggcaccaagaagcugaugaagaucacggccgaguggcucuggaaggagcuggggaagaagaagacgccccggaugugcacccgggaggaguucacccgcaaggugcgguccaacgccgcgcugggcgccaucuucacggacgagaacaaguggaaguccgcccgcgaggccgucgaggacucccgguucugggagcucguggacaaggagcgcaaccugcaccuggaggggaagugcgagaccugcguguacaacaugaugggcaagcgggagaagaagcucggggaguucggcaaggcgaagggcagccgcgccaucugguacauguggcugggggcccgguuccuggaguucgaggcccucggcuuccugaacgaggaccacugguucucccgcgagaacagccugagcggggucgagggcgaggggcuccacaagcugggcuacauccugcgggacguguccaagaaggagggcggggccauguacgcggacgacaccgccggcugggacacccgcaucacgcucgaggaccugaagaacgaggagauggucaccaaccacauggagggggagcacaagaagcuggccgaggccaucuucaagcucaccuaccagaacaagguggugcggguccagcgccccacgccccggggcacggugauggacaucaucagccgccgggaccagcgcggguccggccaggugggcaccuacgggcugaacaccuucaccaacauggaggcccagcugauccgccagauggagggcgagggggucuucaagagcauccagcggcucacggugaccgaggagaucgcggugcagaacuggcuggcccgcgucggccgggagcgccugucccggauggccaucagcggcgacgacugcguggugaagccgcucgacgaccgcuucgccuccgcccugaccgcgcugaacgacauggggaagguccggaaggacauccagcagugggagcccagccgcggcuggaacgacuggacccaggugcccuucugcucccaccacuuccacgagcucaucaugaaggacgggcgggugcuggucgugcccugccgcaaccaggacgagcugaucggccgggcccgcaucagccagggggccggcuggucccucaaggagacggccugccugggcaagagcuacgcccagauguggucccugauguacuuccaccggcgcgaccuccggcuggcggccaacgccaucugcagcgccgugccgucccacuggguccccaccagccgcaccaccugguccauccacgcgaagcacgaguggaugaccacggaggacaugcugaccguguggaaccggguguggauccaggagaaccccuggauggaggacaagacccccgucgagagcugggaggaggugccguaccucgggaagcgcgaggaccaguggugcggcagccugaucgggcugaccucccgggccacgugggccaagaacauccagaccgccaucaaccaggugcgcagccucaucggcaacgaggaguacaccgacuacaugcccuccaugaagcgcuuccggcgcgaggaggaggaggccgggguccugugguga

SEQ ID NO: 9603 - RNA, 9876 nt, Artificial Sequence
  derived and/or modified CDS sequence (opt1) from DENV-2__EU482697__SS-prME
agcgccgggaugaucaucaugcugauccccaccgugauggccuuccaccucaccacccggaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccaugacggacgacaucgggaugggcgugaccuaccuggcccugcucgccgcguucaaggugcgccccaccuucgccgccggccugcugcuccggaagcugaccuccaaggagcugaugaugacgaccaucgggaucguccuccugagccaguccaccauccccgagaccgugcuggagcucacggacgcccuggcccugggcaugauggugcucaagaucguccgcaacauggagaaguaccagcuggcggugaccaucauggccauccugugcgucccgaacgccgugauccuccagaacgccuggaaggugagcugcaccauccuggccgucguguccgugagcccccugcuccugaccuccagccagcagaagacggacuggaucccccuggcgcucaccaucaaggggcugaaccccaccgccaucuuccugaccacgcucucccgcaccaacaagaagcggagcuggccgcugaacgaggccaucauggccgucggcaugguguccauccuggcgagcucccuccugaagaacgacauccccaugaccggcccccugguggccgggggccuccugaccgucugcuacgugcugacggggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacccucacgauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguaccgggaggggaccuuccacaccauguggcacgugacgcgcggcgccguccucaugcacaaggggaagcggaucgagcccuccugggccgacgugaagaaggaccugaucagcuacggcgggggcuggaagcuggagggcgaguggaaggagggggaggaggugcagguccucgcccuggagcccggcaagaacccccgcgcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgguccggcgccuacgugagcgccaucgcccagaccgagaaguccaucgaggacaaccccgagaucgaggacgacaucuuccgcaagcggcgccugacgaucauggaccugcaccccggggcgggcaagaccaagcgguaccuccccgccaucgugcgcgaggccaucaagcgggggcugcgcacccugauccucgccccgacccgggucguggcggccgagauggaggaggcccugcgcggccugcccauccgguaccagacgcccgccauccgcgccgagcacaccgggcgcgagaucguggaccucaugugccacgcgaccuucaccaugcggcugcugagccccguccgcgugccgaacuacaaccucaucaucauggacgaggcccacuucacggaccccgccuccaucgccgcccggggcuacaucagcacccgcguggagaugggcgaggcggccgggaucuucaugaccgccacgccgcccggcagccgggacccguucccccaguccaacgcccccaucaucgacgaggagcgcgagauccccgagcggagcuggaacuccgggcacgagugggucacggacuucaagggcaagaccgugugguucgugccgagcaucaaggccgggaacgacaucgcggccugccugcgcaagaacggcaagaaggucauccagcugucccggaagaccuucgacagcgaguacgugaagacccgcacgaacgacugggacuucguggucaccaccgacaucuccgagaugggcgccaacuucaaggccgagcgggugaucgacccccgccggugcaugaagcccgugauccucaccgacggggaggagcgcgucauccuggcgggccccaugccggugacgcacagcuccgccgcccagcggcgcgggcggaucggccgcaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgggagaagguggacgcgaucgacggcgaguaccgccugcgcggggaggcccggaagaccuucgucgaccucaugcgccggggcgaccugcccguguggcuggccuacaagguggccgccgaggggaucaacuacgcggaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgccggccggaagucccugacgcucaaccugaucaccgagaugggccgccugcccaccuucaugacccagaagacgcgggacgcgcucgacaaccuggccguccugcacaccgccgaggccgggggccgcgcguacaaccacgcccucuccgagcugcccgagacccuggagacccuccugcugcucacgcugcuggccaccgugaccgggggcaucuuccucuuccugaugagcggccgggggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcgcacgccccaggacaaccagcucaccuacgucgugaucgccauccugaccguggucgccgccaccauggcgaacgagaugggcuuccuggagaagacgaagaaggaccucgggcugggcuccaucgccacccagcagccggagagcaacauccuggacaucgaccuccggcccgccuccgccuggacccuguacgccguggcgaccacguucgugacccccaugcugcgccacagcaucgagaacagcuccgucaacgugagccucaccgccaucgccaaccaggccaccgugcugaugggccuggggaagggcuggccccucuccaagauggacaucggggucccgcugcuggccaucggcugcuacagccaggugaaccccaucacgcucaccgcggcccugcugcuccugguggcccacuacgccaucaucgggcccggccugcaggcgaaggccacccgggaggcccagaagcgcgccgccgcgggcaucaugaagaaccccaccgucgacgggaucacggugaucgaccucgacccgauccccuacgaccccaaguucgagaagcagcugggccaggugaugcugcucauccugugcgucacccaggugcugaugaugcggaccaccugggcccucugcgaggcccugacgcuggccaccgggcccaucuccacccucugggagggcaacccggggcgcuucuggaacaccacgaucgccgugagcauggcgaacaucuuccggggcuccuaccuggccggcgccgggcuccucuucagcaucaugaagaacaccaccaacacccgccgcggcacggggaacaugggcgagacccugggcgagaaguggaagucccggcugaacgcccucggcaagagcgaguuccagaucuacaagaaguccggcauccaggaggucgaccgcacccuggccaaggaggggaucaagcggggcgagaccgaccaccacgcggugagccgcggguccgccaagcugcggugguucguggagcgcaacauggucacgcccgagggcaaggugguggaccucggcugcgggcggggcggguggagcuacuacugcggcgggcugaagaacguccgcgaggugaagggccugaccaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgacgguggaggccggccgcacccugcggguccugaaccucguggagaacuggcugaacaacaacacccaguucugcaucaaggugcugaaccccuacaugcccuccgucaucgagaagauggaggcccugcagcgcaaguacggcggggcgcucgugcggaacccgcugagccgcaacagcacccacgagauguacuggguguccaacgccagcggcaacaucgucuccagcgugaacaugaucucccggaugcugaucaaccgcuucaccaugcggcacaagaaggccacguacgagcccgacguggaccucgggagcggcacccgcaacaucgggaccgaguccgagauccccaaccuggacaucaucggcaagcggaucgagaagaucaagcaggagcacgagaccagcuggcacuacgaccaggaccaccccuacaagacgugggccuaccacggcuccuacgagaccaagcagaccgggagcgccuccagcauggucaacggcguggugcgccugcucaccaagccgugggacguccugcccauggugacgcagauggcgaugaccgacaccacccccuucgggcagcagcgcguguucaaggagaaggucgacacgcggacccaggagcccaaggagggcaccaagaagcugaugaagaucaccgccgaguggcucuggaaggagcugggcaagaagaagacgccgcgcaugugcacccgggaggaguucacccgcaaggugcgguccaacgccgcccugggggccaucuucaccgacgagaacaaguggaaguccgcgcgcgaggccguggaggacucccgguucugggagcucgucgacaaggagcgcaacuuccaccuggagggcaagugcgagacgugcguguacaacaugauggggaagcgggagaagaagcugggcgaguucgggaaggccaagggcagccgcgccaucugguacauguggcucggcgcccgguuccuggaguucgaggcgcugggguuccucaacgaggaccacugguucucccgcgagaacagccuguccggcgucgagggggagggccugcacaagcucggguacauccugcgggacgugagcaagaaggagggcggcgccauguacgccgacgacaccgccgggugggacacccgcaucacccuggaggaccucaagaacgaggagauggugacgaaccacauggagggcgagcacaagaagcuggcggaggccaucuucaagcugaccuaccagaacaaggucgugcgggugcagcgccccacgccccgggggaccgucauggacaucaucagccgccgggaccagcgcggcuccggccagguggggacguacggccucaacaccuucaccaacauggaggcccagcugauccggcagauggagggggagggcguguucaagaacauccagcaccugaccgucacggaggagguggccgugaagaacuggcucgcccgcgucgggcgcgagcggcugagccgcauggcgaucuccggcgacgacugcguggugaagccccuggacgaccgguucgccaacgcccucaccgcccugaacgacaugggcaagauccgcaaggacauccagcagugggagccgagcaagggguggaacgacuggacccagguccccuucugcucccaccacuuccacgagcugaucaugaaggacggccgggugcucgugguccccugccgcaaccaggacgagcugaucgggcgggcccgcaucagccagggcgcgggguggucccugcgggagaccgccugccucggcaagagcuacgcccagauguggucccugauguacuuccaccgccgggaccugcgccucgccgccaacgcgaucugcagcgccgugcccucccacugggugccgacgagccggaccaccugguccauccacgccaagcacgaguggaugaccaccgaggacaugcugacggucuggaaccgcguguggauccgggagaaccccuggauggaggacaagacccccguggagagcugggaggagauccccuaccugggcaagcgcgaggaccaguggugcgggucccucaucggccugaccagccgggccaccugggccaagaacauccaggcggccaucaaccagguccgcucccugaucgggaacgaggaguacacggacuacaugccgagcaugaagcgguuccgccgcgaggaggaggaggccggcgugcucugguga

SEQ ID NO: 9604 - RNA, 9876 nt, Artificial Sequence
  derived and/or modified CDS sequence (opt1) from DENV-2__EU482699__SS-prME
agcgccggcaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcgcagcgucgcccuggugccccacguggggaugggccucgagacccggaccgagaccuggauguccagcgagggggccuggaagcacgcccagcggaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgagucccacaaccagaccuuccugaucgacggccccgagacggcggagugcccgaacaccaaccgcgccuggaacagccuggagguggaggacuacggguucggcgucuucaccaccaacaucuggcuccggcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcauccugggcauggcccucuuccuggaggagaugcugcgcacccggguggggacgaagcacgcgauccuccuggccgccguguccuucgucacccugaucaccggcaacaugagcuucaaggaccucgggcgcgugauggugauggucggcgccaccauggccgacgacaucgggaugggcgugacguaccuggcgcugcucgccgccuucaaggugcggcccaccuucgccgccggccugcugcuccgccgccugaccuccaaggagcugaugaugaccacgaucgggaucguccuccugagccaguccaccauccccgagaccgugcuggagcucaccgacgcgcuggcccugggcaugauggugcucaagaucguccggaagauggagaaguaccagcuggccgugacgaucauggccauccugugcgugccgaacgccgucauccuccagaacgcguggaaggugagcugcaccauccuggccgucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggcgaucauggccgucggcaugguguccauccuggccagcucccuccugaagaacgacauccccaugaccggcccccugguggccgggggccuccugaccgucugcuacgugcugaccgggcgcagcgccgaccucgagcuggagcgggcgacggacgugaagugggaggaccaggccgagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggcgggggugcucugggacguccccagcccgccgcccgugggcaaggccgagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggcggacgugaagaaggaccugaucagcuacggcgggggcuggaagcuggagggcgaguggaaggagggggaggagguccaggugcucgcccuggagcccggcaagaacccccgggccgugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgcgaucgcccagaccgagaaguccaucgaggacaaccccgagaucgaggacgacaucuuccggaagcgccggcugaccaucauggaccugcaccccggggccggcaagacgaagcgcuaccuccccgccaucguccgggaggcgaucaagcgcgggcugcggacccugauccucgccccgacccgcgugguggccgccgagauggaggaggcccugcggggccugcccauccgcuaccagacccccgcgauccgcgccgagcacacggggcgggagaucgucgaccucaugugccacgccaccuucaccaugcgccugcugagccccgugcgggugccgaacuacaaccucaucaucauggacgaggcccacuucaccgaccccgccuccaucgcggcccgcggcuacaucagcacgcgggucgagaugggcgaggccgccgggaucuucaugaccgccacgccgcccggcagccgcgacccguucccccaguccaacgcgcccaucaucgacgaggagcgggagauccccgagcgcagcuggaacuccgggcacgagugggugaccgacuucaagggcaagacggugugguucgucccgagcaucaaggccgggaacgacaucgccgccugccugcggaagaacggcaagaaggugauccagcugucccgcaagaccuucgacagcgaguacgugaagacccggaccaacgacugggacuucgucgugacgaccgacaucuccgagaugggcgcgaacuucaaggccgagcgcgugaucgacccccggcgcugcaugaagcccgucauccucaccgacggggaggagcgggugauccuggccggccccaugccggugacccacagcuccgccgcccagcgccgggggcgcaucggccggaaccccaagaacgagaacgaccaguacaucuacaugggggagccccuggagaacgacgaggacugcgcgcacuggaaggaggccaagaugcuccuggacaacaucaacacgcccgagggcaucaucccgagcauguucgagcccgagcgcgagaaggucgacgccaucgacggcgaguaccgccugcgcggggaggcccgcaagaccuucguggaccucaugcggcgcggcgaccugcccguguggcuggccuacaaggucgcggccgaggggaucaacuacgccgaccggcgcuggugcuucgacggcaucaagaacaaccagauccucgaggagaacguggagguggagaucuggaccaagggcggggagaagaagaagcugaagccgcgguggcuggacgcccgcaucuacuccgacccccucgcccugaaggaguucaaggaguucgcggccggccggaagucccugacccucaaccugaucacggagauggggcgccugcccaccuucaugacccagaagacccgggacgcccucgacaaccuggccguccugcacacggcggaggccggcgggcgcgccuacaaccacgcccucuccgagcugcccgagacccuggagacccuccugcugcucacccugcuggccacggugaccggcggcaucuuccucuuccugaugagcgggcggggcaucgggaagaugacccugggcaugugcugcaucaucaccgcguccauccuccugugguacgcccagauccagccgcacuggaucgccgccagcaucauccuggaguucuuccucaucguccugcugauccccgagcccgagaagcagcgcacgccccaggacaaccagcucacguacguggugaucgccauccugaccgucguggcggccaccauggccaacgagaugggguuccuggagaagaccaagaaggaccucggccugggcuccaucgccacgcagcagccggagagcaacauccuggacaucgaccuccggcccgccuccgcguggacccuguacgccguggccaccaccuucgucacgcccaugcugcgccacagcaucgagaacagcuccgugaacgugagccucaccgccaucgccaaccaggcgaccguccugauggggcugggcaagggguggccccucuccaagauggacaucggcgugccgcugcuggccaucgggugcuacagccaggugaaccccaucacccucacggccgcccugcugcuccuggucgcgcacuacgccaucaucggccccggccugcaggccaaggccacccgggaggcccagaagcgcgcggccgccgggaucaugaagaaccccaccguggacggcaucaccgugaucgaccucgacccgauccccuacgaccccaaguucgagaagcagcuggggcaggucaugcugcucauccugugcgugacccaggugcugaugaugcggaccaccugggcccucugcgaggcccugacccuggcgacgggccccaucuccacccucugggaggggaacccgggccgcuucuggaacaccaccaucgccgucagcauggccaacaucuuccggggcuccuaccuggccggggccggccuccucuucagcaucaugaagaacacgaccaacacccgccgcgggaccggcaacaugggcgagacgcugggggagaaguggaagucccggcugaacgcgcucggcaagagcgaguuccagaucuacaagaaguccgggauccaggagguggaccgcacccuggccaaggagggcaucaagcgcggggagaccgaccaccacgccgugagccgcggcuccgccaagcugcggugguucgucgagcgcaacauggugacccccgagggcaagguggucgaccucgggugcggccgcggcggguggagcuacuacugcgggggccugaagaacgugcgcgaggugaagggccugacgaagggcgggcccgggcacgaggagcccaucccgauguccaccuacggcuggaaccucguccggcugcagagcgggguggacguguucuucaucccgcccgagaagugcgacacccugcucugcgacaucggcgaguccagccccaacccgaccgucgaggcgggccgcacgcugcgggugcugaaccucguggagaacuggcugaacaacaacacccaguucugcaucaagguccugaaccccuacaugcccuccgugaucgagaagauggaggcccugcagcgcaaguacgggggcgcccucgugcggaacccgcugagccgcaacagcacccacgagauguacugggucuccaacgccagcgggaacaucguguccagcgugaacaugaucucccggaugcugaucaaccgcuucaccaugcggcacaagaaggccaccuacgagcccgacgucgaccucggcagcgggacgcgcaacaucggcaucgaguccgagauccccaaccuggacaucaucggcaagcggaucgagaagaucaagcaggagcacgagaccagcuggcacuacgaccaggaccaccccuacaagaccugggcguaccacggguccuacgagaccaagcagacgggcagcgccuccagcauggugaacggggugguccgccugcucaccaagccgugggacgugcugcccaccgugacccagauggccaugacggacaccacccccuucggccagcagcgcgucuucaaggagaagguggacacccggacgcaggagcccaaggagggcaccaagaagcugaugaagaucaccgccgaguggcucuggaaggagcuggggaagaagaagaccccgcgcaugugcacgcgggaggaguucacccgcaaggugcgguccaacgccgcgcugggcgccaucuucaccgacgagaacaaguggaaguccgcccgcgaggccgucgaggacucccgguucugggagcucguggacaaggagcgcaaccugcaccuggaggggaagugcgagaccugcguguacaacaugaugggcaagcgggagaagaagcucggggaguucggcaaggccaagggcagccgcgcgaucugguacauguggcugggggcccgguuccuggaguucgaggcccucggcuuccugaacgaggaccacugguucucccgcgagaacagccuguccggggucgagggcgaggggcuccacaagcugggcuacauccugcgggacgugagcaagaaggagggcggggccauguacgcggacgacacggccggcugggacacccgcaucacccucgaggaccugaagaacgaggagauggucaccaaccacauggagggggagcacaagaagcuggccgaggccaucuucaagcucacguaccagaacaagguggugcggguccagcgccccacgccccggggcaccgugauggacaucaucagccgccgggaccagcgcggguccggccaggugggcaccuacgggcugaacacguucaccaacauggaggcccagcugauccggcagauggagggcgagggggucuucaagaacauccagcaccucaccgugaccgaggagguggcgguccagaacuggcuggcccgcgugggccgcgagcggcugagccgcauggccaucuccggcgacgacugcguggucaagccccucgacgaccgguucgccaacgcccugacggcgcugaacgacauggggaagauccgcaaggacauccagcagugggagccgagcaagggcuggaacgacuggacccaggugcccuucugcucccaccacuuccacgagcucaucaugaaggacgggcgggugcuggucgugcccugccgcaaccaggacgagcugaucggccgggcccgcaucagccagggggccggcuggucccuccgggagaccgccugccugggcaagagcuacgcccagauguggucccugauguacuuccaccgccgggaccuccgccuggcggccaacgccaucugcagcgccgugcccucccacugggucccgaccagccggacgaccugguccauccacgccaagcacgaguggaugaccaccgaggacaugcugaccguguggaaccgcguguggauccgggagaaccccuggauggaggacaagacgcccgucgagagcugggaggagauccccuaccucgggaagcgcgaggaccaguggugcggcucccugaucgggcugaccagccgggcgaccugggccaagaacauccaggccgccaucaaccaggugcgcucccucaucggcaacgaggaguacaccgacuacaugccgagcaugaagcgguuccgccgcgaggaggaggaggcgggggugcugugguga

SEQ ID NO: 9605 - RNA, 9876 nt, Artificial Sequence
  derived and/or modified CDS sequence (opt1) from DENV-2__EU482701__SS-prME
agcgcggggaugaucaucaugcugauccccaccgugauggccuuccaccucaccacccggaacggggagccccacaugaucgugggcauccaggagaagggcaagagccugcuguucaagaccgaggacggcgugaacaugugcacccucauggcgauggaccugggggagcugugcgaggacaccaucaccuacaagugcccccuccugaagcagaacgagcccgaggacaucgacugcuggugcaacagcaccuccaccugggugaccuacgggaccugcaccaccaccggcgagcaccggcgcgagaagcggagcguggcccuggugccccacguggggaugggccucgagacgcgcaccgagaccuggauguccagcgagggggccuggaagcacgcccagcggaucgagaccuggauccugcgccacccgggcuucacgaucauggccgcgauccuggccuacaccaucgggaccacccacuuccagcggguccucaucuucauccugcugacggccguggcccccuccaugaccaugcgcugcaucggcaucagcaaccgggacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccgcaaguacugcaucgaggccaagcugaccaacacgaccaccgagagccggugccccacccagggcgagcccucccugaaggaggagcaggacaagcgcuucgugugcaagcacagcaugguggaccggggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccgcaccggccucgacuucaacgagauggugcugcugcagauggagaacaaggccuggcucgugcaccggcagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacgccgcccugacgggcgccaccgagauccagaugagcuccgggaaccuccuguucaccggccaccugaagugccgccugcggauggacaagcuccagcugaagggcaugagcuacuccaugugcaccgggaaguucaagguggucaaggagaucgccgagacgcagcacggcaccaucgugauccgcgugcaguacgagggggacggcagccccugcaagauccccuucgagaucauggaccuggagaagcgguacguccucggccgccugaucaccgugaacccgaucgugaccgagaaggacucccccgucaacaucgaggcggagccgcccuucggggacagcuacaucaucaucggcguggagccggggcagcugaagcucaacugguucaagaagggcuccagcaucgggcagauguucgagacgaccaugcggggcgccaagcgcauggccauccugggcgacaccgccugggacuucgggucccugggcgggguguucaccagcaucggcaaggcccuccaccaggucuucggggcgaucuacggcgccgccuucuccggcgugagcuggacgaugaagauccugaucggggugaucaucaccuggaucggcaugaacucccgcagcaccucccugagcgucucccuggugcucguggggaucgucacccuguaccugggcgugauggugcaggccgacagcgggugcgucguguccuggaagaacaaggagcucaagugcggcagcggcaucuucaucacggacaacgugcacaccuggaccgagcaguacaaguuccagcccgagagccccuccaagcuggcgagcgccauccagaaggcccaggaggaggggaucugcggcauccgguccgucacccgccuggagaaccucauguggaagcagaucacgcccgagcugaaccacauccuggccgagaacgaggugaagcucaccaucaugaccggggacaucaagggcaucaugcaggccgggaagcggagccugcgcccgcagcccaccgagcugaaguacuccuggaagacguggggcaaggcgaagaugcucagcaccgagucccacaaccagaccuuccugaucgacggccccgagaccgccgagugcccgaacacgaaccgggccuggaacagccuggagguggaggacuacggguucggcgucuucaccaccaacaucuggcuccgccugaaggagaagcaggacgccuucugcgacuccaagcugaugagcgccgcggugaaggacaaccgggccgugcacgccgacaugggguacuggaucgaguccgcccucaacgacaccuggaagaucgagaaggccagcuucaucgaggucaagaacugccacuggcccaagucccacacgcuguggagcaacggcgugcuggaguccgagauggugauccccaagaaccucgcgggccccgucagccagcacaacuaccgcccgggguaccacacccagaucgccggccccuggcaccuggggaagcuggagauggacuucgacuucugcgacggcaccaccgugaucgugaccgaggacugcgggaaccggggccccucccuccgcacgaccaccgccagcggcaagcugaucaccgaguggugcugccggagcugcacgcugcccccgcuccgcuaccgcggggaggacggcugcugguacgggauggagauccgcccccugaaggagaaggaggagaaccuggucaacucccucgugaccgccggccacggccagguggacaacuucagccugggcauccugggcauggcccucuuccuggaggagaugcugcggacccgcgucgggaccaagcacgccauccuccugguggccguguccuucgucacgcugaucaccggcaacaugagcuucaaggaccucgggcgggugguggucauggugggcgccaccauggccgacgacaucgggaugggcgugaccuaccuggcgcugcucgccgccuucaagguccgccccacguucgccgccggccugcugcuccggaagcugaccuccaaggagcugaugaugaccaccaucgggguggugcuccugagccaguccacgauccccgacaccguccuggagcucaccgacgcgcuggcccugggcaugauggugcucaagaucguccgcaacauggagaaguaccagcuggccgugaccaucauggccauccugugcgugccgaacgccgucauccuccagaacgcguggaaggugagcugcacgauccuggccguggucuccgugagcccccugcuccugaccuccagccagcagaagaccgacuggaucccccuggcccucaccaucaaggggcugaaccccacggccaucuuccugaccacccucucccgcaccaacaagaagcggagcuggccgcugaacgaggcgaucauggccgugggcauggucuccauccuggccagcucccuccugaagaacgacauccccaugacgggcccccugguggccgggggccuccugaccgugugcuacguccugaccgggcgcagcgccgaccucgagcuggagcgggcgaccgacgugaagugggaggaccaggccgagaucuccggcagcagccccauccuguccaucacgaucagcgaggacggguccaugagcaucaagaacgaggaggaggagcagacccucaccauccugauccgcaccggccugcucgugaucuccggccuguucccgaucagcauccccaucacggccgccgccugguaccugugggaggucaagaagcagcgggcgggggugcucugggacgugcccagcccgccgcccaugggcaaggccgagcuggaggacggggccuaccgcaucaagcagaagggcauccugggguacagccagaucggcgccggcgucuacaaggaggggaccuuccacaccauguggcacgugacccggggcgccgugcucaugcacaaggggaagcgcaucgagcccuccugggcggacgucaagaaggaccugaucagcuacggcgggggcuggaagcuggagggcgaguggaaggagggggaggagguccaggugcucgcccuggagcccggcaagaacccccgggccguccagaccaagcccgggcuguucaagacgaacaccggcaccaucggggccgugucccucgacuucagccccggcaccuccggcagccccaucaucgacaagaaggggaagguggucggccuguacgggaacggcguggugacgcgcuccggcgccuacgucagcgcgaucgcccagaccgagaaguccaucgaggacaaccccgagaucgaggacgacaucuuccggaagcgccggcugaccaucauggaccugcaccccggggccggcaagaccaagcgcuaccuccccgccaucgugcgggaggcgaucaagcgcgggcugcggacgcugauccucgccccgacccgcguggucgccgccgagauggaggaggcccugcggggccugcccauccgcuaccagacccccgcgauccgggccgagcacaccgggcgcgagaucguggaccucaugugccacgccacguucaccaugcgccugcugagccccgugcgggucccgaacuacaaccucaucaucauggacgaggcccacuucaccgaccccgccuccaucgcggcccgcggcuacaucagcacccggguggagaugggcgaggccgccgggaucuucaugacggccacgccgcccggcagccgcgacccguucccccaguccaacgcgcccaucaucgacgaggagcgggagauccccgagcgcagcuggaacuccgggcacgagugggugaccgacuucaagggcaagaccgucugguucgugccgagcaucaaggccgggaacgacaucgccgccugccugcggaagaacggcaagaaggugauccagcugucccgcaagacguucgacagcgaguacgucaagacccggaccaacgacugggacuucguggugaccacggacaucuccgagaugggcgcgaacuucaaggccgagcgcgucaucgacccccggcgcugcaugaagcccgugauccucaccgacggggaggagcgggugauccuggccggccccaugccggucacccacagcuccgccgcccagcgccgggggcgcaucggccggaaccccaagaacgagaacgaccaguacaucuacaugggggagccccuggagaacgacgaggacugcgcgcacuggaaggaggccaagaugcuccuggacaacaucaacacccccgagggcaucaucccgagcauguucgagcccgagcgcgagaagguggacgccaucgacggcgaguaccggcugcgcggggaggcccgcaagacguucguggaccucaugcggcgcggcgaccugcccgucuggcuggccuacaagguggcggccgaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgcggccggccgcaagagccugacccucaaccugaucaccgagaugggccggcugcccacguucaugacccagaagacccgcgacgcccucgacaaccuggccgugcugcacaccgcggaggccgggggccgggccuacaaccacgcccucuccgagcugcccgagacgcuggagacccuccugcugcucacccugcuggccaccgucaccggcgggaucuuccucuuccugaugagcgggcgcgggaucggcaagaugacccuggggaugugcugcaucaucaccgcguccauccuccugugguacgcccagauccagccgcacuggaucgccgccagcaucauccuggaguucuuccucaucgugcugcugauccccgagcccgagaagcagcggacgccccaggacaaccagcucaccuacguggucaucgccauccugacggugguggcggccaccauggccaacgagaugggcuuccuggagaagaccaagaaggaccucgggcugggcuccaucgccacccagcagccggagagcaacauccuggacaucgaccuccgccccgccuccgcguggacgcuguacgccgucgccaccaccuucgugacccccaugcugcggcacagcaucgagaacagcuccgugaacgucagccucacggccaucgccaaccaggcgaccgugcugaugggccuggggaagggcuggccccucuccaagauggacaucggggugccgcugcuggccaucggcugcuacagccaggucaaccccaucacccucaccgccgcccugcugcuccugguggcgcacuacgccaucaucgggcccggccugcaggccaaggccacgcgcgaggcccagaagcgggcggccgccggcaucaugaagaaccccaccguggacgggaucaccgucaucgaccucgacccgauccccuacgaccccaaguucgagaagcagcugggccaggugaugcugcucauccugugcgugacccagguccugaugaugcgcacgaccugggcccucugcgaggcccugacccuggcgaccgggcccaucuccacgcucugggagggcaacccggggcgguucuggaacaccaccaucgccgugagcauggccaacaucuuccgcggcuccuaccuggccggcgccgggcuccucuucagcaucaugaagaacaccacgaacacccggcgcggcaccgggaacaugggcgagacccugggcgagaaguggaagucccgccugaacgcgcucgggaaguccgaguuccagaucuacaagaaguccggcauccaggagguggaccggacgcuggccaaggaggggaucaagcgcggcgagaccgaccaccacgccgucagccggggguccgccaagcugcgcugguucguggagcggaacauggugacccccgagggcaaggucguggaccucggcugcgggcgcggcggguggagcuacuacugcggcgggcugaagaacgugcgggaggucaagggccugaccaagggcgggcccggccacgaggagcccaucccgauguccacguacggguggaaccucgugcgccugcagagcggcguggacgucuucuucaucccgcccgagaagugcgacacccugcucugcgacaucggggaguccagccccaacccgaccguggaggcgggccggacccugcgcgugcugaaccucgucgagaacuggcugaacaacaacacgcaguucugcaucaaggugcugaaccccuacaugcccuccgugaucgagaagauggaggcccugcagcggaaguacggcggggcccucguccgcaacccgcugagccggaacagcacccacgagauguacuggguguccaacgccagcggcaacaucguguccagcgucaacaugaucucccgcaugcugaucaaccgguucaccaugcgccacaagaaggccaccuacgagcccgacguggaccucgggagcggcacccggaacaucgggaucgaguccgagauccccaaccuggacaucaucggcaagcgcaucgagaagaucaagcaggagcacgagacgagcuggcacuacgaccaggaccaccccuacaagaccugggcguaccacggcuccuacgagaccaagcagaccgggagcgccuccagcauggugaacggcgucgugcggcugcucacgaagccgugggacgugcugcccaccgucacccagauggccaugaccgacacgacccccuucgggcagcagcgcguguucaaggagaagguggacacccgcacccaggagcccaaggagggcacgaagaagcugaugaagaucaccgccgaguggcucuggaaggagcugggcaagaagaagaccccgcggaugugcacccgcgaggaguucacgcggaagguccgcuccaacgccgcgcugggggccaucuucaccgacgagaacaaguggaaguccgcccgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggcgaucugguacauguggcugggcgcccgcuuccuggaguucgaggcccucggguuccugaacgaggaccacugguucucccgggagaacagccuguccggcguggagggggagggccuccacaagcugggguacauccugcgcgacgucagcaagaaggagggcggcgccauguacgcggacgacaccgccgggugggacacgcggaucacccucgaggaccugaagaacgaggagauggugaccaaccacauggagggcgagcacaagaagcuggccgaggccaucuucaagcucaccuaccagaacaaggugguccgcgugcagcggcccacgccccgcgggaccgugauggacaucaucagccggcgcgaccagcggggcuccgggcaggucggcaccuacggccugaacaccuucacgaacauggaggcccagcugauccgccagauggagggggagggcguguucaagaacauccagcaccucaccgugaccgaggaggucgcggugcagaacuggcuggcccggguggggcgcgagcgccugagccggauggccaucuccggcgacgacugcgucgugaagccccucgacgaccgcuucgccaacgcccugaccgcgcugaacgacaugggcaagauccggaaggacauccagcagugggagccgagcaagggguggaacgacuggacgcagguccccuucugcucccaccacuuccacgagcucaucaugaaggacggccgcguccugguggugcccugccggaaccaggacgagcugaucgggcgcgcccggaucagccagggcgccggguggucccuccgcgagaccgccugccugggcaagagcuacgcccagauguggucccugauguacuuccaccggcgcgaccuccggcuggcggccaacgccaucugcagcgccguccccucccacugggugccgaccagccgcaccacgugguccauccacgccaagcacgaguggaugaccaccgaggacaugcugaccguguggaaccgggucuggauccgcgagaaccccuggauggaggacaagacccccguggagagcugggaggagauccccuaccucggcaagcgggaggaccaguggugcgggucccugaucggccugacgagccgcgcgaccugggccaagaacauccaggccgccaucaaccaggugcggucccucaucgggaacgaggaguacaccgacuacaugccgagcaugaagcgcuuccggcgcgaggaggaggaggcgggcguccugugguga

SEQ ID NO: 9606 - RNA, 9876 nt, Artificial Sequence
  derived and/or modified CDS sequence (opt1) from DENV-2__EU482703__SS-prME
agcgccgggaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcgcagcgucgcccuggugccccacguggggaugggccucgagacccggaccgagaccuggaugagcagcgagggggccuggaagcacgcccagcggaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaagguggggugcaccauccuggcggucgugagcgugagcccccugcuccugaccagcucccagcagaagaccgacuggaucccccuggcccucacgaucaagggccugaaccccaccgccaucuuccugaccacccucagccgcacgaacaagaagcgguccuggccgcugaacgaggccaucauggcggucggcauggugagcauccuggccuccagccuccugaagaacgacauccccaugaccgggccccugguggccggcgggcuccugaccgucugcuacgugcugaccggccgcuccgccgaccucgagcuggagcgggccacggacgugaagugggaggaccaggcggagaucagcggguccagccccauccugagcaucaccaucuccgaggacggcagcauguccaucaagaacgaggaggaggagcagacccucaccauccugauccgcacgggccugcucgucaucagcgggcuguucccgaucuccauccccaucaccgccgccgccugguaccugugggaggugaagaagcagcgggccggcgugcucugggacguccccuccccgccgcccauggggaaggcggagcuggaggacggcgccuaccgcaucaagcagaaggggauccugggcuacucccagaucggcgccgggguguacaaggagggcaccuuccacaccauguggcacgugacccgcggggccguccucaugcacaagggcaagcgcaucgagcccagcugggccgacgugaagaaggaccugaucuccuacgggggcggcuggaagcuggagggggaguggaaggagggcgaggaggugcagguccucgcgcuggagcccgggaagaacccccgggccgugcagacgaagcccggccuguucaagaccaacaccgggaccaucggcgccgugagccucgacuucucccccggcacgagcgggucccccaucaucgacaagaagggcaaggucguggggcuguacggcaacggcguggucacccgcagcggggccuacguguccgccaucgcgcagaccgagaaguccaucgaggacaaccccgagaucgaggacgacaucuuccggaagcgccggcugaccaucauggaccugcaccccggcgccgggaagacgaagcgcuaccuccccgccaucgugcgggaggccaucaagcgcggccugcggacccugauccucgcgccgacccgcgucguggccgccgagauggaggaggcccugcgggggcugcccauccgcuaccagacccccgccauccgggcggagcacacgggccgcgagaucguggaccucaugugccacgccaccuucaccaugcgccugcugucccccguccgggugccgaacuacaaccucaucaucauggacgaggcccacuucaccgaccccgccagcaucgccgcgcgcggcuacaucuccacgcggguggagaugggggaggccgccggcaucuucaugaccgccacgccgcccgggagccgcgacccguucccccagagcaacgcccccaucaucgacgaggagcgggagauccccgagcgcuccuggaacagcggccacgagugggucaccgacuucaaggggaagacggugugguucgugccguccaucaaggcgggcaacgacaucgccgccugccugcggaagaacggcaagaaggucauccagcugagccgcaagaccuucgacuccgaguacgugaagacccggaccaacgacugggacuucguggucacgaccgacaucagcgagaugggggccaacuucaaggcggagcgcgugaucgacccccggcgcugcaugaagcccgugauccucaccgacggcgaggagcgggucauccuggccgggcccaugccggugacccacuccagcgccgcccagcgccggggccgcaucgggcggaaccccaagaacgagaacgaccaguacaucuacaugggcgagccccuggagaacgacgaggacugcgcccacuggaaggaggcgaagaugcuccuggacaacaucaacacgcccgagggcaucaucccguccauguucgagcccgagcgcgagaagguggacgccaucgacggggaguaccggcugcgcggcgaggcccgcaagaccuucgucgaccucaugcggcgcggggaccugcccguguggcuggccuacaagguggccgcggagggcaucaacuacgccgaccggcgcuggugcuucgacgggaucaagaacaaccagauccucgaggagaacgucgagguggagaucuggaccaaggagggcgagcggaagaagcugaagccgcgcuggcuggacgcccggaucuacagcgacccccucgcccugaaggaguucaaggaguucgccgcgggccgcaagucccugacccucaaccugaucacggagauggggcggcugcccaccuucaugacccagaagacccgcgacgcccucgacaaccuggccguccugcacacggccgaggcgggcgggcgggccuacaaccacgcccucagcgagcugcccgagacccuggagacccuccugcugcucacccugcuggccacggugaccggcggcaucuuccucuuccugauguccgggcgcggcaucgggaagaugacccugggcaugugcugcaucaucaccgccagcauccuccugugguacgcgcagauccagccgcacuggaucgccgccuccaucauccuggaguucuuccucaucgugcugcugauccccgagcccgagaagcagcggacgccccaggacaaccagcucacguacgucgugaucgccauccugaccguggucgccgcgaccauggccaacgagaugggguuccuggagaagaccaagaaggaccucggccugggcagcaucgccacgcagcagccggaguccaacauccuggacaucgaccuccgccccgccagcgccuggacccuguacgcgguggccaccaccuucgugacgcccaugcugcggcacuccaucgagaacagcagcgucaacgugucccucaccgccaucgccaaccaggccaccgugcugauggggcugggcaagggguggccccucagcaagauggacaucggcgucccgcugcuggcgaucgggugcuacucccaggugaaccccaucacccucacggccgcccugcugcuccugguggcccacuacgcgaucaucggccccggccugcaggccaaggccacccgcgaggcccagaagcgggccgcggccgggaucaugaagaaccccaccgucgacggcaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacgggccccaucagcacccucugggaggggaacccgggccgguucuggaacaccaccaucgcgguguccauggccaacaucuuccgcggcagcuaccuggccggggccggccuccucuucuccaucaugaagaacacgaccaacacccggcgcgggaccggcaacaugggcgagacgcugggggagaaguggaagucccgccugaacgcccucggcaaguccgaguuccagaucuacaagcggagcgggauccaggaggucgaccgcacccuggcgaaggagggcaucaagcgcggggagaccgaccaccacgccgugucccgcggcagcgccaagcugcggugguucguggagcgcaacauggucacccccgagggcaaggugguggaccucgggugcggccgcggcgggugguccuacuacugcgggggccugaagaacguccgcgaggugaagggccugacgaagggcgggcccgggcacgaggagcccaucccgaugagcaccuacggcuggaaccucgugcggcugcaguccggggucgacguguucuucaucccgcccgagaagugcgacacccugcucugcgacaucggcgagagcucccccaacccgaccguggaggccggccgcacgcugcggguccugaaccucguggagaacuggcugaacaacaacacccaguucugcaucaaggugcugaaccccuacaugcccagcgucaucgagaagauggaggcgcugcagcgcaaguacgggggcgcccucgugcggaacccgcugucccgcaacagcacccacgagauguacugggugagcaacgccuccgggaacaucgucagcuccgugaacaugaucagccggaugcugaucaaccgcuucaccaugcggcacaagaaggccaccuacgagcccgacguggaccucggcuccgggacgcgcaacaucggcaucgagagcgagauccccaaccuggacaucaucggcaagcggaucgagaagaucaagcaggagcacgagaccuccuggcacuacgaccaggaccaccccuacaagaccugggccuaccacgggagcuacgagaccaagcagacgggcuccgcgagcuccauggucaacgggguggugcgccugcucaccaagccgugggacguccugcccaccgugacccagauggccaugacggacaccacccccuucggccagcagcgcguguucaaggagaaggucgacacccggacgcaggagcccaaggagggcaccaagaagcugaugaagaucaccgccgaguggcucuggaaggagcuggggaagaagaagaccccgcgcaugugcacgcgggaggaguucaccaagaaggugcgcagcaacgccgcccugggcgcgaucuucaccgacgagaacaaguggaaguccgcccgggaggccguggaggacagccgcuucugggagcucgucgacaaggagcggaaccugcaccuggaggggaagugcgagaccugcguguacaacaugaugggcaagcgcgagaagaagcucggggaguucggcaaggccaagggcucccgggccaucugguacauguggcugggggcgcgcuuccuggaguucgaggcccucggcuuccugaacgaggaccacugguucagccgggagaacucccugagcggggucgagggcgaggggcuccacaagcugggcuacauccugcgcgacguguccaagaaggagggcggggccauguacgccgacgacacggcgggcugggacacccggaucacccucgaggaccugaagaacgaggagauggugaccaaccacaugaagggggagcacaagaagcuggccgaggccaucuucaagcucacguaccagaacaaggucgugcgcgugcagcggcccacgccccggggcaccgucauggacaucaucagccggcgcgaccagcgggggagcggccaggugggcaccuacgggcugaacacguucaccaacauggaggcccagcugauccgccagauggagggcgaggggguguucaagaacauccagcaccucaccgucaccgaggagguggccgugcagaacuggcuggcgcgggucggccgcgagcgccugucccggauggccaucagcggcgacgacugcguggugaagccccucgacgaccgcuucgccaacgcccugacggcccugaacgacauggggaagauccggaaggacauccagcagugggagccguccaagggcuggaacgacuggacccagguccccuucugcagccaccacuuccacgagcucaucaugaaggacgggcgcgugcuggugguccccugccggaaccaggacgagcugaucggccgcgcgcggaucucccagggggccggcuggagccuccgcgagaccgccugccugggcaaguccuacgcccagauguggagccugauguacuuccaccggcgcgaccuccggcuggccgcgaacgccaucugcuccgccgugcccagccacugggugccgaccucccgcacgaccuggagcauccacgccaagcacgaguggaugaccaccgaggacaugcugaccgucuggaaccggguguggauccgcgagaaccccuggauggaggacaagacgcccguggaguccugggaggagauccccuaccucgggaagcgggaggaccaguggugcggcagccugaucgggcugaccucccgcgccaccugggcgaagaacauccaggccgccaucaaccagguccggagccucaucggcaacgaggaguacaccgacuacaugccguccaugaagcgcuuccggcgcgaggaggaggaggccggggugcugugguga

SEQ ID NO: 9607 - RNA, 9876 nt, Artificial Sequence
  derived and/or modified CDS sequence (opt1) from DENV-2__EU482705__SS-prME
agcgccgggaugaucaucaugcugauccccaccgugauggccuuccaccucaccacccgcaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacgaccgagugcccgaacaccaaccgcgcguggaacagccuggagguggaggacuacggguucggcgucuucaccacgaacaucuggcucaagcugaaggagaagcaggacgccuucugcgacuccaagcugaugagcgccgccaucaaggacaaccgggccgugcacgcggacaugggguacuggaucgaguccgcccucaacgacaccuggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgccggccccuggcaccuggggaagcuggagauggacuucgacuucugcgacggcaccacggugaucgucaccgaggacugcgggaaccggggccccucccuccgcaccaccacggcgagcggcaagcugaucaccgaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacgcgcguggggaccaagcacgccauccuccuggucgcgguguccuucgugacccugaucaccggcaacaugagcuucaaggaccucgggcgggucguggugauggucggcgccacgauggccgacaacaucgggaugggcgugaccuaccuggcccugcucgccgcguucaaggugcgccccaccuucgccgccggccugcugcuccggcgccugaccuccaaggagcugaugaugacgaccaucgggaucguccuccugagccaguccaccauccccgagaccgugcuggagcucacggacgcccuggcccugggcaugauggugcucaagaucguccgcaacauggagaaguaccagcuggcggugaccaucauggccauccugugcgucccgaacgccgugauccuccagaacgccuggaaggugagcugcaccauccuggccgucguguccgugagcccccugcuccugaccuccagccagcagaagacggacuggaucccccuggcgcucaccaucaaggggcugaaccccaccgccaucuuccugaccacgcucucccggaccaacaagaagcgcagcuggccgcugaacgaggccaucauggccgucggcaugguguccauccuggcgagcucccuccugaagaacgacauccccaugaccggcccccugguggccgggggccuccugaccgucugcuacgugcugacggggcggagcgccgaccucgagcuggagcgcgccaccgacgugaagugggaggaccaggccgagaucuccggcagcagccccauccuguccaucaccaucagcgaggacggguccaugagcaucaagaacgaggaggaggagcagacccucacgauccugauccggaccggccugcucgucaucuccggccuguucccgaucagcauccccaucaccgcggccgccugguaccugugggaggugaagaagcagcgcgccggggugcucugggacguccccagcccgccgcccaugggcaaggccgagcuggaggacggggcguaccggaucaagcagaagggcauccugggguacagccagaucggcgccggcguguacaaggaggggaccuuccacaccauguggcacgugacgcgcggcgccguccucaugcacaaggggaagcggaucgagcccuccugggccgacgugaagaaggaccugaucagcuacggcgggggcuggaagcuggagggcgaguggaaggagggggaggaggugcagguccucgcccuggagcccggcaagaacccccgcgcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgguccggcgccuacgugagcgccaucgcccagaccgagaaguccaucgaggacaaccccgagaucgaggacgacaucuuccgcaagcggcgccugacgaucauggaccugcaccccggggcgggcaagaccaagcgguaccuccccgccaucgugcgcgaggccaucaagcgggggcugcgcacccugauccucgccccgacccgggucguggcggccgagauggaggaggcccugcgcggccugcccauccgguaccagacgcccgccauccgcgccgagcacaccgggcgcgagaucguggaccucaugugccacgcgaccuucaccaugcggcugcugagccccguccgcgugccgaacuacaaccucaucaucauggacgaggcccacuucacggaccccgccuccaucgccgcccggggcuacaucagcacccgcguggagaugggcgaggcggccgggaucuucaugaccgccacgccgcccggcagccgggacccguucccccaguccaacgcccccaucaucgacgaggagcgcgagauccccgagcggagcuggaacuccgggcacgagugggucacggacuucaagggcaagaccgugugguucgugccgagcaucaaggccgggaacgacaucgcggccugccugcgcaagaacggcaagaaggucauccagcugucccggaagaccuucgacagcgaguacgugaagacccgcacgaacgacugggacuucguggucaccaccgacaucuccgagaugggcgccaacuucaaggccgagcgggugaucgacccccgccggugcaugaagcccgugauccucaccgacggggaggagcgcgucauccuggcgggccccaugccggugacgcacagcuccgccgcccagcggcgcgggcggaucggccgcaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgggagaagguggacgcgaucgacggcgaguaccgccugcgcggggaggcccggaagaccuucgucgaccucaugcgccggggcgaccugcccguguggcuggccuacaagguggccgccgaggggaucaacuacgcggaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgccggccggaagucccugacgcucaaccugaucaccgagaugggccgccugcccaccuucaugacccagaagacgcgggacgcgcucgacaaccuggccguccugcacaccgccgaggccgggggccgcgcguacaaccacgcccucuccgagcugcccgagacccuggagacccuccugcugcucacgcugcuggccaccgugaccgggggcaucuuccucuuccugaugagcggccgggggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcgcacgccccaggacaaccagcucaccuacgucgugaucgccauccugaccguggucgccgccaccauggcgaacgagaugggcuuccuggagaagacgaagaaggaccucgggcugggcuccaucgccacccagcagccggagagcaacauccuggacaucgaccuccggcccgccuccgccuggacccuguacgccguggcgaccacguucgugacccccaugcugcgccacagcaucgagaacagcuccgucaacgugagccucaccgccaucgccaaccaggccaccgugcugaugggccuggggaagggcuggccccucuccaagauggacaucggggucccgcugcuggccaucggcugcuacagccaggugaaccccaucacgcucaccgcggcccugcugcuccugguggcccacuacgccaucaucgggcccggccugcaggcgaaggccacccgggaggcccagaagcgcgccgccgcgggcaucaugaagaaccccaccgucgacgggaucacggugaucgaccucgacccgauccccuacgaccccaaguucgagaagcagcugggccaggugaugcugcucauccugugcgucacccaggugcugaugaugcggaccaccugggcccucugcgaggcccugacgcuggccaccgggcccaucuccacccucugggagggcaacccggggcgcuucuggaacaccacgaucgccgugagcauggcgaacaucuuccggggcuccuaccuggccggcgccgggcuccucuucagcaucaugaagaacaccaccaacacccgccgcggcacggggaacaucggcgagacccugggcgagaaguggaagucccggcugaacgcccucggcaagagcgaguuccagaucuacaagaaguccggcauccaggaggucgaccgcacccuggccaaggaggggaucaagcggggcgagaccgaccaccacgcggugagccgcggguccgccaagcugcggugguucguggagcgcaacauggucacgcccgagggcaaggugguggaccucggcugcgggcggggcggguggagcuacuacugcggcgggcugaagaacguccgcgaggugaagggccugaccaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgacgguggaggccggccgcacccugcggguccugaaccucguggagaacuggcugaacaacaacacccaguucugcaucaaggugcugaaccccuacaugcccuccgucaucgagaagauggaggcccugcagcgcaaguacggcggggcgcucgugcggaacccgcugagccgcaacagcacccacgagauguacuggguguccaacgccagcggcaacaucgucuccagcgugaacaugaucucccggaugcugaucaaccgcuucaccaugcggcacaagaaggccacguacgagcccgacguggaccucgggagcggcacccgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggucaacggcguggugcgccugcucaccaagccgugggacguccugcccaccgugacgcagauggcgaugaccgacaccacccccuucgggcagcagcgcguguucaaggagaaggucgacacgcggacccaggagcccaaggagggcaccaagaagcugaugaagaucaccgccgaguggcucuggaaggagcugggcaagaagaagacgccgcgcaugugcacccgggaggaguucacccgcaaggugcgguccaacgccgcccugggggccaucuucaccgacgagaacaaguggaaguccgcgcgcgaggccguggaggacucccgguucugggagcucgucgacaaggagcgcaaccugcaccuggagggcaagugcgagacgugcguguacaacaugauggggaagcgggagaagaagcucggcgaguucgggaaggccaagggcagccgcgccaucugguacauguggcugggcgcccgguuccuggaguucgaggcgcucggguuccugaacgaggaccacugguucucccgcgagaacagccuguccggcgucgagggggagggccuccacaagcugggguacauccugcgggacgugagcaagaaggagggcggcgccauguacgccgacgacaccgccgggugggacacccgcaucacccucgaggaccugaagaacgaggagauggugacgaaccacauggagggcgagcacaagcggcuggcggaggccaucuucaagcucaccuaccagaacaaggucgugcgcgugcagcggcccacgccccgggggaccgucauggacaucaucagccggcgcgaccagcggggcuccggccagguggggacguacggccugaacaccuucaccaacauggaggcccagcugauccgccagauggagggggagggcguguucaagaacauccagcaccucaccgucacggaggagguggccgugcagaacuggcuggcccgcgucgggcgggagcgccugagccggauggcgaucuccggcgacgacugcguggugaagccccucgacgaccgcuucgccaacgcccugaccgcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcccggaucagccagggcgcgggguggucccuccgcgagaccgccugccugggcaagagcuacgcccagauguggucccugauguacuuccaccggcgcgaccuccggcuggccgccaacgcgaucugcagcgccgugcccucccacugggugccgacgagccgcaccaccugguccauccacgccaagcacgaguggaugaccaccgaggacaugcugacggucuggaaccggguguggauccgcgagaaccccuggauggaggacaagacccccguggagagcugggaggagauccccuaccucggcaagcgggaggaccaguggugcgggucccugaucggccugaccagccgcgccaccugggccaagaacauccaggcggccaucaaccagguccggucccucaucgggaacgaggaguacacggacuacaugccgagcaugaagcgcuuccgccgggaggaggaggaggccggcgugcugugguga

SEQ ID NO: 9608 - RNA, 9876 nt, Artificial Sequence
  derived and/or modified CDS sequence (opt1) from DENV-2__EU482463__SS-prME
agcgccggcaugaucaucaugcugauccccaccgugauggccuuccaccucaccacccggaacggggagccccacaugaucgucagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcgcuccgucgcccuggugccccacgugggcauggggcucgagacccggaccgagaccuggaugagcuccgagggcgccuggaagcacgcccagcggaucgagaccuggauccugcggcacccgggguucacgaucauggccgcgauccuggccuacaccaucggcaccacccacuuccagcgcguccucaucuucauccugcugacggccguggcccccagcaugaccaugcggugcaucgggaucuccaaccgcgacuucguggagggcgucagcggcggguccuggguggacaucgugcucgagcacggcagcugcgucaccaccauggcgaagaacaagcccacgcuggacuucgagcugaucaagaccgaggccaagcagcccgccacccuccggaaguacugcaucgaggccaagcugaccaacacgaccaccgagucccgcugccccacccagggggagcccagccugaaggaggagcaggacaagcgguucgugugcaagcacuccaugguggaccgcggcuggggcaacgggugcggccucuucgggaagggcgggaucgucacgugcgccauguucacgugcaagaagaacauggagggcaagaucgugcagcccgagaaccuggaguacaccaucguggucacgccccacagcggcgaggagcacgcgguggggaacgacacgggcaagcacgggaaggagaucaaggugaccccgcaguccagcaucaccgaggccgagcugaccggcuacgggaccgucacgauggagugcagcccccggaccggccucgacuucaacgagauggugcugcugcagauggagaacaaggccuggcucgugcaccgccagugguuccuggaccugccccuccccuggcugccgggcgccgacaagcaggagagcaacuggauccagaaggagacccuggucaccuucaagaacccccacgccaagaagcaggacguggucgugcucgggagccaggagggcgcgaugcacacggcccugaccggggccaccgagauccagauguccagcggcaaccugcuguucaccgggcaccugaagugccggcugcgcauggacaagcuccagcugaagggcauguccuacagcaugugcacgggcaaguucaagguggucaaggagaucgccgagacccagcacgggaccaucgugauccgggugcaguacgagggcgacgggucccccugcaagauccccuucgagaucauggaccuggagaagcgcuacguccucggccggcugaucaccgugaacccgaucgugacggagaaggacagccccgucaacaucgaggccgagccgcccuucggcgacuccuacaucaucaucgggguggagccgggccagcugaagcucaacugguucaagaaggggagcuccaucggccagauguucgagaccaccaugcgcggggcgaagcgcauggccauccugggcgacaccgccugggacuucggcagccucggcgggguguucacguccaucgggaaggcccuccaccaggucuucggggccaucuacggggcggccuucagcggcguguccuggaccaugaagauccugaucggcgugaucaucaccuggaucgggaugaacagccgguccaccagccuguccgucagccuggugcucgugggcaucgucacgcuguaccugggggugauggugcaggccgacuccggcugcgucgugagcuggaagaacaaggagcucaagugcgggagcggcaucuucaucaccgacaacgugcacaccuggaccgagcaguacaaguuccagcccgagucccccagcaagcuggccuccgcgauccagaaggcccaggaggagggcaucugcgggauccgcagcgucacgcggcuggagaaccucauguggaagcagaucacccccgagcugaaccacauccuggccgagaacgaggugaagcucaccaucaugaccggcgacauccgcgggaucaugcaggccggcaagcggucccugcgcccgcagcccacggagcugaaguacagcuggaagaccugggggaaggccaagaugcucuccaccgagagcuacaaccagaccuuccugaucgacggccccgagacggcggagugcccgaacaccaaccgggccuggaacucccuggagguggaggacuacggcuucggggucuucaccaccaacaucuggcucaagcugaaggagaagcaggacgccuucugcgacagcaagcugauguccgccgccaucaaggacaaccgcgcggugcacgccgacaugggcuacuggaucgagagcgcccucaacgacacguggaagaucgagaaggccuccuucaucgaggugaagaacugccacuggcccaagagccacacccugugguccaacgggguccuggagagcgagaugaucauccccaagaaccucgccggccccgugucccagcacaacuaccggccgggcuaccacacccagaucgcggggcccuggcaccugggcaagcuggagauggacuucgacuucugcgacgggaccaccgugaucgucacggaggacugcggcaaccgcgggcccagccuccggaccaccaccgccagcggcaagcugaucacggaguggugcugccgcuccugcacccugcccccgcuccgguaccgcggcgaggacgggugcugguacggcauggagauccggccccugaaggagaaggaggagaaccuggugaacagccucgugaccgccgggcacggccaggucgacaacuucucccugggggugcugggcauggcccucuuccuggaggagaugcugcgcacccgggugggcacgaagcacgcgauccuccuggucgccgugagcuucgugacccugaucaccgggaacauguccuucaaggaccucggccgcgucguggugauggucggggccaccauggccgacgacaucggcaugggggugacguaccuggcccugcucgcggccuucaaggugcggcccaccuucgccgccggccugcugcuccgcaagcugaccagcaaggagcugaugaugaccacgaucggcaucguccuccugucccagagcaccauccccgagaccgugcuggagcucaccgacgcccuggcgcuggggaugauggugcucaagaucguccgcaacauggagaaguaccagcuggccgugacgaucauggccauccugugcgucccgaacgccgugauccuccagaacgccuggaagguguccugcaccauccuggcggucgugagcgugagcccccugcuccugaccagcucccagcagaagaccgacuggaucccccuggcccucacgaucaagggccugaaccccaccgccaucuuccugaccacccucagccggacgaacaagaagcgcuccuggccgcugaacgaggccaucauggcggucgggauggugagcauccuggccuccagccuccugaagaacgacauccccaugaccggcccccugguggccggcgggcuccugaccgucugcuacgugcugaccggccgguccgccgaccucgagcuggagcgcgccacggacgugaagugggaggaccaggcggagaucagcgggagcucccccauccugagcaucaccaucuccgaggacggcagcauguccaucaagaacgaggaggaggagcagacccucaccauccugauccggacggggcugcucgucaucagcggccuguucccgaucuccauccccaucaccgccgccgccugguaccugugggaggugaagaagcagcgcgccggcgugcucugggacguccccuccccgccgcccauggggaaggcggagcuggaggacggcgccuaccggaucaagcagaaggggauccugggcuacucccagaucggggccggcguguacaaggagggcaccuuccacaccauguggcacgugacccgcggggccguccucaugcacaagggcaagcggaucgagcccagcugggccgacgugaagaaggaccugaucuccuacgggggcggguggaagcuggagggcgaguggaaggagggcgaggaggugcagguccucgcgcuggagcccgggaagaacccccgcgccgugcagacgaagcccggccuguucaagaccaacaccgggaccaucggcgccgugagccucgacuucucccccgggacgagcggcucccccaucaucgacaagaagggcaaggucguggggcuguacggcaacgggguggucacccggagcggcgccuacguguccgccaucgcgcagaccgagaaguccaucgaggacaaccccgagaucgaggacgacaucuuccgcaagcggcgccugaccaucauggaccugcaccccggcgccgggaagacgaagcgguaccuccccgccaucgugcgcgaggccaucaagcggggccugcgcacccugauccucgcgccgacccgggucguggccgccgagauggaggaggcccugcgcgggcugcccauccgguaccagacccccgccauccgcgcggagcacacgggccgcgagaucguggaccucaugugccacgccaccuucaccaugcggcugcugucccccguccgcgugccgaacuacaaccucaucaucauggacgaggcccacuucaccgaccccgccagcaucgccgcgcggggguacaucagcacgcgcguggagaugggcgaggccgccggcaucuucaugaccgccacgccgcccgggucccgggacccguucccccagagcaacgcccccaucaucgacgaggagcgcgagauccccgagcgguccuggaacagcggccacgagugggucaccgacuucaaggggaagacggugugguucgugccguccaucaaggcgggcaacgacaucgccgccugccugcgcaagaacgggaagaaggucauccagcugagccggaagaccuucgacuccgaguacgugaagacccgcaccaacgacugggacuucguggucacgaccgacaucagcgagaugggcgccaacuucaaggcggagcgggugaucgacccccgccggugcaugaagcccgugauccucaccgacggcgaggagcgcgucauccuggccgggcccaugccggugacccacuccagcgccgcccagcggcgcggccggaucgggcgcaaccccaagaacgagaacgaccaguacaucuacaugggcgagccccuggagaacgacgaggacugcgcccacuggaaggaggcgaagaugcuccuggacaacaucaacacgcccgaggggaucaucccguccauguucgagcccgagcgggagaagguggacgccaucgacggcgaguaccgccugcgcggcgaggcccggaagaccuucgucgaccucaugcgccgcggggaccugcccguguggcuggccuacaagguggccgcggagggcaucaacuacgccgaccgccgguggugcuucgacgggaucaagaacaaccagauccucgaggagaacgucgagguggagaucuggaccaaggagggcgagcgcaagaagcugaagccgcgguggcuggacgcccgcaucuacagcgacccccucgcccugaaggaguucaaggaguucgccgcggggcggaagucccugacccucaaccugaucacggagaugggccgccugcccaccuucaugacccagaagacccgggacgcccucgacaaccuggccguccugcacacggccgaggcgggcgggcgcgccuacaaccacgcccucagcgagcugcccgagacccuggagacccuccugcugcucacccugcuggccacggugaccggcgggaucuuccucuuccugauguccggccggggcaucgggaagaugacccugggcaugugcugcaucaucaccgccagcauccuccugugguacgcgcagauccagccgcacuggaucgccgccuccaucauccuggaguucuuccucaucgugcugcugauccccgagcccgagaagcagcgcacgccccaggacaaccagcucacguacgucgugaucgccauccugaccguggucgccgcgaccauggccaacgagaugggguuccuggagaagaccaagaaggaccucggccuggggagcaucgccacgcagcagccggaguccaacauccuggacaucgaccuccggcccgccagcgccuggacccuguacgcgguggccaccaccuucgugacgcccaugcugcgccacagcaucgagaacuccagcgucaacgugucccucaccgccaucgccaaccaggccaccgugcugaugggccugggcaagggguggccccucagcaagauggacaucggcgucccgcugcuggcgaucgggugcuacucccaggugaaccccaucacccucacggccgcccugcugcuccugguggcccacuacgcgaucaucggccccgggcugcaggccaaggccacccgggaggcccagaagcgcgccgcggccggcaucaugaagaaccccaccgucgacggcaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacgggccccaucagcacccucugggaggggaacccgggccgcuucuggaacaccaccaucgcgguguccauggccaacaucuuccgggggagcuaccuggccggcgccggccuccuguucuccaucaugaagaacacgaccaacacccgccgcgggaccggcaacaucggggagacgcugggcgagaaguggaagucccggcugaacgcccucggcaaguccgaguuccagaucuacaagaaguccgggauccaggaggucgaccgcacccuggcgaaggagggcaucaagcgcggggagaccgaccaccacgccgugucccgcggcagcgccaagcugcggugguucguggagcgcaacauggucacccccgaggggaaggugguggaccucggcugcggccgcggcgggugguccuacuacugcggcgggcugaagaacguccgcgaggugaaggggcugacgaagggcgggcccgggcacgaggagcccaucccgaugagcaccuacggcuggaaccucgugcggcugcaguccggggucgacguguucuucaucccgcccgagaagugcgacacccugcucugcgacaucggcgagagcucccccaacccgaccguggaggccgggcgcacgcugcggguccugaaccucguggagaacuggcugaacaacaacacccaguucugcaucaaggugcugaaccccuacaugcccagcgucaucgagaagauggaggcgcugcagcgcaaguacggcggcgcccucgugcggaacccgcugagccgcaacuccacccacgagauguacugggugagcaacgccuccgggaacaucgucagcuccgugaacaugaucagccggaugcugaucaaccgcuucaccaugcggcacaagaaggccaccuacgagcccgacguggaccucggcuccgggacgcgcaacaucggcaucgagagcgagaagcccaaccuggacaucaucgggaagcggaucgagaagaucaagcaggagcacgagaccuccuggcacuacgaccaggaccaccccuacaagaccugggccuaccacggcagcuacgagaccaagcagacgggcuccgcgagcuccauggucaacgggguggugcgccugcucaccaagccgugggacguccugcccaccgugacccagauggccaugacggacaccacccccuucggccagcagcgcguguucaaggagaaggucgacacccggacgcaggagcccaaggaggggaccaagaagcugaugaagaucaccgccgaguggcucuggaaggagcugggcaagaagaagaccccgcgcaugugcacgcgggaggaguucacccgcaaggugcggagcaacgccgcccugggcgcgaucuucaccgacgagaacaaguggaaguccgcccgcgaggccguggaggacagccgguucugggagcucgucgacaaggagcgcaaccugcaccuggaggggaagugcgagaccugcguguacaacaugaugggcaagcgggagaagaagcucggggaguucggcaaggccaaggggucccgcgccaucugguacauguggcugggcgcgcgguuccuggaguucgaggcccucggcuuccugaacgaggaccacugguucagccgcgagaacucccugagcggggucgagggcgaggggcuccacaagcugggcuacauccugcgggacgugagcaagaaggagggcggcgccauguacgccgacgacacggcgggcugggacacccgcaucacccucgaggaccugaagaacgaggagauggugaccaaccacauggagggggagcacaagaagcuggccgaggccaucuucaagcucacguaccagaacaaggucgugcgggugcagcgccccacgccccggggcaccgucauggacaucaucucccgccgggaccagcgcgggagcggccagguggggaccuacggccugaacacguucaccaacauggaggcccagcugauccggcagauggagggcgaggggguguucaagaacauccagcaccucaccgucaccgaggagguggccgugcacaacuggcuggcgcgcgucggccgcgagcggcugucccgcauggccaucagcggggacgacugcguggugaagccccucgacgaccgguucgccaacgcccugacggcccugaacgacaugggcaagauccgcaaggacauccagcagugggagccguccaagggcuggaacgacuggacccagguccccuucugcagccaccacuuccacgagcucaucaugaaggacgggcgggugcuggugguccccugccgcaaccaggacgagcugaucggccgggcgcgcaucucccagggggccggcuggagccuccgggagaccgccugccuggggaaguccuacgcccagauguggagccugauguacuuccaccgccgggaccuccgccuggccgcgaacgccaucugcuccgccgugcccagccacugggugccgaccucccggacgaccuggagcauccacgccaagcacgaguggaugaccaccgaggacaugcugaccgucuggaaccgcguguggauccgggagaaccccuggauggaggacaagacgcccguggaguccugggaggagauccccuaccucggcaagcgcgaggaccaguggugcggcagccugaucgggcugaccucccgggccaccugggcgaagaacauccaggccgccaucaaccagguccgcagccucaucggcaacgaggaguacaccgacuacaugccgagcaugaagcgguuccgccgcgaggaggaggaggccggggugcugugguga

SEQ ID NO: 9609 - RNA, 9876 nt, Artificial Sequence
  derived and/or modified CDS sequence (opt1) from DENV-2__EU482464__SS-prME
agcgcgggcaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacgaccgagugcccgaacaccaaccgcgcguggaacagccuggagguggaggacuacggguucggcgucuucaccacgaacaucuggcucaagcugaaggagaagcaggacgccuucugcgacuccaagcugaugagcgccgccaucaaggacaaccgggccgugcacgcggacaugggguacuggaucgaguccgcccucaacgacaccuggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgccggccccuggcaccuggggaagcuggagauggacuucgacuucugcgacggcaccacggugaucgucaccgaggacugcgggaaccggggccccucccuccgcaccaccacggcgagcggcaagcugaucaccgaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacgcgcguggggaccaagcacgccauccuccuggucgcgguguccuucgugacccugaucaccggcaacaugagcuucaaggaccucgggcgggucguggugauggucggcacgaccauggccgacgacaucgggaugggcgugaccuaccuggcccugcucgccgccuucaaggugcgccccaccuucgcggccggccugcugcuccggaagcugacguccaaggagcugaugaugaccaccaucgggaucguccuccugagccaguccaccauccccgagacggugcuggagcucaccgacgcccuggcccugggcaugauggugcucaagaucguccgcaacauggagaaguaccagcuggccgugaccaucauggcgauccugugcgucccgaacgccgugauccuccagaacgccuggaaggugagcugcaccauccuggccgucguguccgugagcccccugcuccugacguccagccagcagaagaccgacuggaucccccuggcccucaccaucaaggggcugaaccccaccgcgaucuuccugacgacccucucccgcaccaacaagaagcggagcuggccgcugaacgaggccaucauggccgucggcaugguguccauccuggccagcucccuccugaagaacgacauccccaugaccggcccccugguggccggcgggcuccugacggucugcuacgugcugaccgggcgcagcgccgaccucgagcuggagcgggccaccgacgugaagugggaggaccaggccgagaucuccgggagcagccccauccuguccaucaccaucagcgaggacggguccaugagcaucaagaacgaggaggaggagcagacgcucaccauccugauccgcaccggccugcucgucaucuccggccuguucccgaucagcauccccaucaccgccgcggccugguaccugugggaggugaagaagcagcgggccggggugcucugggacguccccagcccgccgcccaugggcaaggccgagcuggaggacggggccuaccgcaucaagcagaagggcauccugggguacagccagaucggcgcgggcguguacaaggaggggaccuuccacacgauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggccgugcagaccaagcccgggcuguucaagaccaacacgggcaccaucggggcggugucccucgacuucagccccggcaccuccggcagccccaucaucgacaagaaggggaaggucgugggccuguacgggaacggcguggucacccgcuccggcgccuacgugagcgccaucgcccagacggagaaguccaucgaggacaaccccgagaucgaggacgacaucuuccggaagcgccggcugaccaucauggaccugcaccccggggccggcaagaccaagcgcuaccuccccgcgaucgugcgggaggccaucaagcgcgggcugcggacccugauccucgccccgacgcgcgucguggccgcggagauggaggaggcccugcggggccugcccauccgcuaccagacccccgccauccgggccgagcacaccgggcgcgagaucguggaccucaugugccacgccaccuucacgaugcgccugcugagccccguccgggugccgaacuacaaccucaucaucauggacgaggcgcacuucaccgaccccgccuccaucgccgcccgcggcuacaucagcacccggguggagaugggcgaggccgcggggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagaccgugugguucgugccgagcaucaaggccgggaacgacaucgccgcgugccugcggaagaacggcaagaaggucauccagcugucccgcaagaccuucgacagcgaguacgugaagacgcggaccaacgacugggacuucguggucaccaccgacaucuccgagaugggcgccaacuucaaggccgagcgcgugaucgacccccggcgcugcaugaagcccgugauccucacggacggggaggagcgggucauccuggccggccccaugccggugacccacagcuccgcggcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgccaucgacggcgaguaccggcugcgcggggaggcgcgcaagaccuucgucgaccucaugcggcgcggcgaccugcccguguggcuggccuacaagguggccgccgaggggaucaacuacgccgaccggcgcuggugcuucgacggcaucaagaacaaccagauccucgaggagaacgucgagguggagaucuggacgaaggagggggagcggaagaagcugaagccgcgcuggcuggacgcgcggaucuacuccgacccccucgcccugaaggaguucaaggaguucgccgccggccgcaagagccugacccucaaccugaucaccgagaugggccggcugcccaccuucaugacgcagaagacccgcgacgcccucgacaaccuggcgguccugcacaccgccgaggccgggggccgggccuacaaccacgcgcucuccgagcugcccgagacccuggagacgcuccugcugcucacccugcuggccaccgugaccgggggcaucuuccucuuccugaugagcggccgcgggaucggcaagaugacccuggggaugugcugcaucaucacggccuccauccuccugugguacgcccagauccagccgcacuggaucgccgcgagcaucauccuggaguucuuccucaucgugcugcugauccccgagcccgagaagcagcggacgccccaggacaaccagcucaccuacgucgugaucgccauccugaccguggucgccgccacgauggccaacgagaugggcuuccuggagaagaccaagaaggaccucgggcugggcuccaucgcgacccagcagccggagagcaacauccuggacaucgaccuccgccccgccuccgccuggacccuguacgccguggccacgaccuucgugacccccaugcugcggcacagcaucgagaacagcuccgucaacgugagccucaccgcgaucgccaaccaggccacggugcugaugggccuggggaagggcuggccccucuccaagauggacaucggggucccgcugcuggccaucggcugcuacagccaggugaaccccaucacccucaccgccgcgcugcugcuccugguggcccacuacgccaucaucgggcccggccugcaggccaaggcgacccgcgaggcccagaagcgggccgccgccggcaucaugaagaaccccacggucgacgggaucaccgugaucgaccucgacccgauccccuacgaccccaaguucgagaagcagcugggccaggugaugcugcucauccugugcgucacccaggugcugaugaugcgcaccacgugggcgcucugcgaggcccugacccuggccaccgggcccaucuccacccucugggagggcaacccggggcgguucuggaacacgaccaucgccgugagcauggccaacaucuuccgcggcuccuaccuggcgggcgccgggcuccucuucagcaucaugaagaacaccaccaacacgcggcgcggcaccgggaacaucggcgagacccugggcgagaaguggaagucccgccugaacgcccucgggaaguccgaguuccagaucuacaagaaguccggcauccaggaggucgaccggacccuggccaaggaggggaucaagcgcggcgagacggaccaccacgccgugagccggggguccgcgaagcugcgcugguucguggagcggaacauggucacccccgagggcaaggugguggaccucggcugcgggcgcggcggguggagcuacuacugcggcgggcugaagaacguccgggaggugaagggccugaccaagggcgggcccggccacgaggagcccaucccgauguccaccuacggguggaaccucgugcgccugcagagcggcgucgacguguucuucaucccgcccgagaagugcgacacgcugcucugcgacaucggggaguccagccccaacccgaccguggaggccggccggacccugcgcguccugaaccucguggagaacuggcugaacaacaacacccaguucugcaucaaggugcugaaccccuacaugcccuccgucaucgagaagauggaggcccugcagcggaaguacggcggggcccucgugcgcaacccgcugagccggaacagcacccacgagauguacuggguguccaacgcgagcggcaacaucgucuccagcgugaacaugaucucccgcaugcugaucaaccgguucacgaugcgccacaagaaggccaccuacgagcccgacguggaccucgggagcggcacccggaacaucgggaucgaguccgagauccccaaccuggacaucaucggcaagcgcaucgagaagaucaagcaggagcacgagaccagcuggcacuacgaccaggaccaccccuacaagacgugggccuaccacggcuccuacgagaccaagcagaccgggagcgccuccagcauggucaacggcguggugcggcugcucaccaagccgugggacguccugcccacggugacccagauggccaugaccgacaccacgcccuucgggcagcagcgcguguucaaggagaaggucgacacccgcacccaggagcccaaggagggcaccaagaagcugaugaagaucacggcggaguggcucuggaaggagcugggcaagaagaagaccccgcggaugugcacccgcgaggaguucacccggaaggugcgcuccaacgccgcccugggggccaucuucacggacgagaacaaguggaaguccgcccgggaggcgguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcccgcuuccuggaguucgaggcccucggguuccugaacgaggaccacugguucucccgggagaacagccuguccggcgucgagggggagggccuccacaagcugggguacauccugcgcgacgugagcaagaaggagggcggcgcgauguacgccgacgacaccgccgggugggacacccggaucacgcucgaggaccugaagaacgaggagauggugaccaaccacauggagggcgagcacaagaagcuggccgaggcgaucuucaagcucaccuaccagaacaaggucgugcgcgugcagcggcccacgccccgggggacggucauggacaucaucagccggcgcgaccagcggggcuccggccagguggggaccuacggccugaacaccuucaccaacauggaggcccagcugauccgccagauggagggggagggcguguucaagaacauccagcaccucacggucaccgaggagguggccgugcagaacuggcuggcccgggucgggcgcgagcgccugagccggauggccaucuccggcgacgacugcguggugaagccccucgacgaccgcuucgcgaacgcccuggccgcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcccggaucagccagggcgcgggguggucccuccgcgagaccgccugccugggcaagagcuacgcccagauguggucccugauguacuuccaccggcgcgaccuccggcuggccgccaacgcgaucugcagcgccgugcccucccacugggugccgacgagccgcaccaccugguccauccacgccaagcacgaguggaugaccaccgaggacaugcugacggucuggaaccggguguggauccgcgagaaccccuggauggaggacaagacccccguggagagcugggaggagauccccuaccucggcaagcgggaggaccaguggugcgggucccugaucggccugaccagccgcgccaccugggccaagaacauccaggcggccaucaaccagguccggucccucaucgggaacgaggaguacacggacuacaugccgagcaugaagcgcuuccggcgcgaggaggaggaggccggcgugcugugguga

SEQ ID NO: 9610 - RNA, 9876 nt, Artificial Sequence
  derived and/or modified CDS sequence (opt1) from DENV-2__EU482465__SS-prME
agcgcggggaugaucaucaugcugauccccaccgugauggccuuccaccucaccacccggaacggggagccccacaugaucgugggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucaucugcaagcacagcaugguggaccgcggcugggggaacggcugcggccuguucggcaagggcgggaucgugacgugcgccauguucacgugcaagaagaacauggagggcaagaucguccagcccgagaaccuggaguacaccaucguggugacgccccacuccggggaggagcacgcggucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggagaacaaggccuggcucgugcaccgccagugguuccuggaccugccccuccccuggcugccgggggccgacaagcaggaguccaacuggauccagaaggagacccuggugaccuucaagaacccccacgccaagaagcaggacgucgugguccucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggugaaggagaucgccgagacccagcacggcaccaucgucauccgggugcaguacgagggggacggcagccccugcaagauccccuucgagaucauggaccuggagaagcgcuacgugcucggccggcugaucaccgucaacccgaucgugacggagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccagguguucggggccaucuacggcgcggccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcguguucaccaccaacaucuggcucaagcugaaggagaagcaggacgccuucugcgacuccaagcugaugagcgccgccaucaaggacaaccgggcgguccacgccgacaugggguacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgccggccccgucagccagcacaacuaccgcccgggguaccacacccagaucgcgggccccuggcaccuggggaagcuggagauggacuucgacuucugcgacggcaccaccgugaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggucaacucccucgugaccgccggccacggccagguggacaacuucagccugggcguccugggcauggcccucuuccuggaggagaugcugcggacccgcguggggacgaagcacgcgauccuccugguggccgucuccuucgugacccugaucaccggcaacaugagcuucaaggaccucgggcggguggucgugauggugggcgccaccauggccgacgacaucgggaugggcgucacguaccuggcccugcucgcggccuucaaggugcgccccaccuucgccgccggccugcugcuccggaagcugaccuccaaggagcugaugaugaccacgaucgggaucgugcuccugagccaguccaccauccccgagaccguccuggagcucaccgacgcccuggcgcugggcaugauggugcucaagaucgugcgcaacauggagaaguaccagcuggccgucacgaucauggccauccugugcgugccgaacgccgucauccuccagaacgccuggaaggugagcugcaccauccuggcgguggucuccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcauggucuccauccuggccagcucccuccugaagaacgacauccccaugaccggcccccugguggccgggggccuccugaccgugugcuacguccugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggucaagaagcagcgggccggggugcucugggacgugcccagcccgccgcccaugggcaaggcggagcuggaggacggggccuaccgcaucaagcagaagggcauccugggguacagccagaucggcgccggcgucuacaaggaggggaccuuccacaccauguggcacgugacccggggcgccgugcucaugcacaaggggaagcgcaucgagcccuccugggccgacgucaagaaggaccugaucagcuacggcgggggcuggaagcuggagggcgaguggaaggagggggaggagguccaggugcucgcgcuggagcccggcaagaacccccgggccguccagacgaagcccgggcuguucaagaccaacaccggcaccaucggggccgugucccucgacuucagccccggcacguccggcagccccaucaucgacaagaaggggaagguggucggccuguacgggaacggcguggugacccgcuccggcgccuacgucagcgccaucgcgcagaccgagaaguccaccgaggacaaccccgagaucgaggacgacaucuuccggaagcgccggcugacgaucauggaccugcaccccggggccggcaagaccaagcgcuaccuccccgccaucgugcgggaggccaucaagcgcgggcugcggacccugauccucgcgccgacccgcguggucgccgccgagauggaggaggcccugcggggccugcccauccgcuaccagacgcccgccauccgggcggagcacaccgggcgcgagaucguggaccucaugugccacgccaccuucaccaugcgccugcugagccccgugcgggucccgaacuacaaccucaucaucauggacgaggcccacuucacggaccccgccuccaucgccgcgcgcggcuacaucagcacccggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugacggacuucaagggcaagaccgucugguucgugccgagcaucaaggcggggaacgacaucgccgccugccugcggaagaacggcaagaaggugauccagcugucccgcaagaccuucgacagcgaguacgucaagacccggacgaacgacugggacuucguggugaccaccgacaucuccgagaugggcgccaacuucaaggcggagcgcgucaucgacccccggcgcugcaugaagcccgugauccucaccgacggggaggagcgggugauccuggccggccccaugccggucacgcacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacccccgagggcaucaucccgagcauguucgagcccgagcgcgagaagguggacgccaucgacggcgaguaccggcugcgcggggaggcccgcaagaccuucguggaccucaugcggcgcggcgaccugcccgucuggcuggccuacaagguggccgcggaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgcgggccgcaagagccugacgcucaaccugaucaccgagaugggccggcugcccaccuucaugacccagaagacgcgcgacgcccucgacaaccuggccgugcugcacaccgccgaggccggcgggcgggccuacaaccacgcccucuccgagcugcccgagacccuggagacccuccugcugcucacgcugcuggccaccgucaccgggggcaucuuccucuuccugaugagcggccgcgggaucggcaagaugacccuggggaugugcugcaucaccacggccuccauccuccugugguacgcgcagauccagccgcacuggaucgccgccagcaucauccuggaguucuuccucaucgugcugcugauccccgagcccgagaagcagcggacgccccaggacaaccagcucaccuacguggucaucgccauccugaccgugguggccgcgacgauggccaacgagaugggcuuccuggagaagaccaagaaggaccucgggcugggcuccaucgccacccagcagccggagagcaacauccuggacaucgaccuccgccccgccuccgccuggacccuguacgcggucgccacgaccuucgugacccccaugcugcggcacagcaucgagaacagcuccgugaacgucagccucaccgccaucgccaaccaggccacggugcugaugggccuggggaagggcuggccccucuccaagauggacaucggggugccgcugcuggcgaucggcugcuacagccaggucaaccccaucacccucaccgccgcccugcugcuccugguggcccacuacgcgaucaucgggcccggccugcaggccaaggccacccgcgaggcccagaagcgggccgcggccggcaucaugaagaaccccacgguggacgggaucaccgucaucgaccucgacccgauccccuacgaccccaaguucgagaagcagcugggccaggugaugcugcucauccugugcgugacccagguccugaugaugcgcaccacgugggcccucugcgaggcccugacccuggccaccgggcccaucuccacccucugggagggcaacccggggcgguucuggaacacgaccaucgcggugagcauggccaacaucuuccgcggcuccuaccuggccggcgccgggcuccucuucagcaucaugaagaacaccaccaacacgcggcgcggcaccgggaacaugggcgagacccugggcgagaaguggaagucccgccugaacgcccucgggaaguccgaguuccagaucuacaagcgguccggcauccaggagguggaccgcacccuggcgaaggaggggaucaagcggggcgagacggaccaccacgccgucagccgcggguccgccaagcugcggugguucguggagcgcaacauggugacccccgagggcaaggucguggaccucggcugcgggcggggcggguggagcuacuacugcggcgggcugaagaacgugcgcgaggucaagggccugaccaagggcgggcccggccacgaggagcccaucccgauguccaccuacggguggaaccucgugcggcugcagagcggcguggacgucuucuucaucccgcccgagaagugcgacacgcugcucugcgacaucggggaguccagccccaacccgaccguggaggccggccgcacccugcgggugcugaaccucgucgagaacuggcugaacaacaacacccaguucugcaucaaggugcugaaccccuacaugcccuccgugaucgagaagauggaggcgcugcagcgcaaguacggcggggcccucguccggaacccgcugagccgcaacagcacccacgagauguacuggguguccaacgccagcggcaacaucguguccagcgucaacaugaucucccggaugcugaucaaccgcuucacgaugcggcacaagaaggccaccuacgagcccgacguggaccucgggagcggcacccgcaacaucgggaucgaguccgagauccccaaccuggacaucaucggcaagcggaucgagaagaucaagcaggagcacgagaccagcuggcacuacgaccaggaccaccccuacaagacgugggccuaccacggcuccuacgagaccaagcagaccgggagcgcguccagcauggugaacggcgucgugcgccugcucaccaagccgugggacgugcugcccacggucacccagauggccaugaccgacaccacgcccuucgggcagcagcgcguguucaaggagaagguggacacccggacccaggagcccaaggagggcaccaagaagcugaugaagaucacggccgaguggcucuggaaggagcugggcaagaagaagaccccgcgcaugugcacccgggaggaguucacccgcaagguccgguccaacgccgcccugggggcgaucuucacggacgagaacaaguggaaguccgcccgcgaggccguggaggacucccgguucugggagcucguggacaaggagcgcaaccugcaccuggagggcaagugcgagaccugcgucuacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcguggagggggagggccuccacaagcugggguacauccugcgggacgucagcaagaaggagggcggcgccauguacgccgacgacaccgcggggugggacacccgcaucacgcucgaggaccugaagaacgaggagauggugaccaaccacauggagggcgagcacaagaagcuggccgaggccaucuucaagcucaccuaccagaacaaggugguccgggugcagcgccccacgccccgggggacggugauggacaucaucagccgccgggaccagcgcggcuccgggcaggucggcaccuacggccugaacaccuucaccaacauggaggcccagcugauccggcagauggagggggagggcguguucaagaacauccagcaccucacggugaccgaggaggucgccgugcagaacuggcuggcgcgcguggggcgcgagcggcugagccgcauggccaucuccggcgacgacugcgucgugaagccccucgacgaccgguucgccaacgcccugaccgcccugaacgacaugggcaagauccgcaaggacauccagcagugggagccgagcaagggguggaacgacuggacccaggugcccuucugcucccaccacuuccacgagcucaucaugaaggacggccggguccugguggugcccugccgcaaccaggacgagcugaucgggcgggcgcgcaucagccagggcgccggguggucccuccgggagacggccugccugggcaagagcuacgcccagauguggucccugauguacuuccaccgccgggaccuccgccuggccgcgaacgccaucugcagcgccguccccucccacugggugccgaccagccggaccaccugguccauccacgccaagcacgaguggaugaccacggaggacaugcugaccguguggaaccgcgucuggauccgggagaaccccuggauggaggacaagacccccguggagagcugggaggagauccccuaccucggcaagcgcgaggaccaguggugcgggucccugaucggccugaccagccgggccacgugggcgaagaacauccaggccgccaucaaccaggugcgcucccucaucgggaacgaggaguacaccgacuacaugccgagcaugaagcgguuccgccgcgaggaggaggaggccggcguccugugguga

SEQ ID NO: 9611 - RNA, 9876 nt, Artificial Sequence
  derived and/or modified CDS sequence (opt1) from DENV-2__EU482466__SS-prME
agcgcggggaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcaccccggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugcccgacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccccugccgaugggcaaggcggagcuggaggacggggccuaccgcaucaagcagaagggcauccucggguacagccagaucggcgccggcguguacaaggaggggaccuuccacaccauguggcacgugacccggggcgccguccugaugcacaaggggaagcgcaucgagcccuccugggccgacgugaagaaggaccugaucagcuacggcgggggcuggaagcucgagggcgaguggaaggagggggaggaggugcagguccuggcgcuggagcccggcaagaacccgcgggccgugcagacgaagcccggccucuucaagaccaacaccggcaccaucggggccgugucccuggacuucagccccggcacguccggcagccccaucaucgacaagaaggggaaggucgugggccuguacgggaacggcguggucacccgcuccggcgccuacgugagcgccaucgcgcagaccgagaaguccaucgaggacaacccggagaucgaggacgacaucuuccggaagcgccggcugaccaucauggaccuccaccccggggccggcaagacgaagcgcuaccugcccgccaucgugcgggaggccaucaagcgcgggcugcggacccucauccuggcgcccacccgcgucguggccgccgagauggaggaggcccugcggggccucccgauccgcuaccagacccccgccauccgggcggagcacacggggcgcgagaucguggaccugaugugccacgccaccuucaccaugcgccugcucagccccguccgggugcccaacuacaaccugaucaucauggacgaggcccacuucaccgacccggccuccaucgccgcgcgcggcuacaucagcacgcggguggagaugggcgaggccgccgggaucuucaugaccgccacgccgcccggcagccgcgaccccuucccgcaguccaacgcccccaucaucgacgaggagcgggagauccccgagcgcagcuggaacuccgggcacgagugggucaccgacuucaagggcaagacggugugguucgugcccagcaucaaggcggggaacgacaucgccgccugccugcggaagaacggcaagaaggucauccagcucucccgcaagaccuucgacagcgaguacgugaagacccggaccaacgacugggacuucguggucacgaccgacaucuccgagaugggcgccaacuucaaggcggagcgcgugaucgacccgcggcgcugcaugaagcccgugauccugaccgacggggaggagcgggucauccuggccggccccaugcccgugacccacagcuccgccgcccagcgccgggggcgcaucggccggaacccgaagaacgagaacgaccaguacaucuacaugggggagccccucgagaacgacgaggacugcgcccacuggaaggaggcgaagaugcugcuggacaacaucaacacgcccgagggcaucauccccagcauguucgagccggagcgcgagaagguggacgccaucgacggcgaguaccggcuccgcggggaggcccgcaagaccuucgucgaccugaugcggcgcggcgaccugcccguguggcucgccuacaagguggccgcggaggggaucaacuacgccgaccggcgcuggugcuucgacggcaucaagaacaaccagauccuggaggagaacgucgagguggagaucuggaccaaggagggggagcggaagaagcugaagccccgcuggcucgacgcccggaucuacuccgacccgcuggcccugaaggaguucaaggaguucgccgcgggccgcaagagccucacccugaaccugaucacggagaugggccggcuccccaccuucaugacccagaagacccgcgacgcccuggacaaccuggccguccuccacacggccgaggccggcgggcgggccuacaaccacgcccuguccgagcugcccgagacccucgagacccugcugcuccugacccugcucgccacggugaccgggggcaucuuccuguuccugaugagcggccgcgggaucggcaagaugacccucgggaugugcugcaucaucaccgccuccauccugcugugguacgcgcagauccagccccacuggaucgccgccagcaucauccucgaguucuuccugaucgugcugcucaucccggagcccgagaagcagcggacgccccaggacaaccagcugacguacgucgugaucgccauccugaccguggucgccgcgaccauggccaacgagaugggcuuccucgagaagaccaagaaggaccuggggcugggcuccaucgccacgcagcagcccgagagcaacauccucgacaucgaccugcgcccggccuccgccuggacccuguacgcgguggccaccaccuucgugacgcccaugcuccggcacagcaucgagaacagcuccgucaacgugagccugaccgccaucgccaaccaggccaccgugcugaugggccucgggaagggcuggccccuguccaagauggacaucggggucccccugcucgcgaucggcugcuacagccaggugaacccgaucacccugacggccgcccugcuccugcugguggcccacuacgcgaucaucgggcccggccuccaggccaaggccacccgcgaggcccagaagcgggccgcggccggcaucaugaagaaccccaccgucgacgggaucaccgugaucgaccuggaccccaucccguacgaccccaaguucgagaagcagcugggccaggugaugcuccugauccugugcgucacccaggugcucaugaugcgcaccaccugggcccugugcgaggcccugacccucgccacggggcccaucuccacccugugggagggcaaccccgggcgguucuggaacaccaccaucgcggugagcauggccaacaucuuccgcggcuccuaccuggccggcgccgggcuccuguucagcaucaugaagaacacgaccaacacccggcgcggcaccgggaacaugggcgagacgcugggcgagaaguggaagucccgccucaacgcccuggggaaguccgaguuccagaucuacaagaaguccggcauccaggaggucgaccggacccuggcgaaggaggggaucaagcgcggcgagaccgaccaccacgccgugagccggggguccgccaagcuccgcugguucguggagcggaacauggucaccccggagggcaaggugguggaccugggcugcgggcgcggcggguggagcuacuacugcggcgggcugaagaacguccgggaggugaagggccucacgaagggcgggcccggccacgaggagcccauccccauguccaccuacggguggaaccuggugcgccugcagagcggcgucgacguguucuucaucccgcccgagaagugcgacacccuccugugcgacaucggggaguccagccccaaccccaccguggaggccggccggacgcugcgcguccucaaccugguggagaacuggcugaacaacaacacccaguucugcaucaaggugcugaacccguacaugcccuccgucaucgagaagauggaggcgcuccagcggaaguacggcggggcccuggugcgcaacccccugagccggaacagcacccacgagauguacuggguguccaacgccagcggcaacaucgucuccagcgugaacaugaucucccgcaugcucaucaaccgguucaccaugcgccacaagaaggccaccuacgagccggacguggaccuggggagcggcacgcggaacaucgggaucgaguccgagacccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgcguccagcauggucaacggcguggugcggcuccugaccaagcccugggacguccugccgaccgugacgcagauggccaugaccgacaccacccccuucgggcagcagcgcguguucaaggagaaggucgacacgcgcacccaggagcccaaggagggcaccaagaagcucaugaagaucaccgccgaguggcuguggaaggagcugggcaagaagaagacgccccggaugugcacccgcgaggaguucacccggaaggugcgcuccaacgccgcccucggggcgaucuucaccgacgagaacaaguggaaguccgcccgggaggccguggaggacucccgcuucugggagcuggucgacaaggagcggaaccugcaccucgagggcaagugcgagacgugcguguacaacaugauggggaagcgcgagaagaagcugggcgaguucgggaaggccaagggcagccgggccaucugguacauguggcugggcgcgcgcuuccucgaguucgaggcccugggguuccugaacgaggaccacugguucucccgggagaacagccucuccggcgucgagggggagggccugcacaagcugggguacauccuccgcgacgugagcaagaaggagggcggcgccauguacgccgacgacaccgcggggugggacacccggaucacccuggaggaccugaagaacgaggagauggugacgaaccacauggagggcgagcacaagaagcucgccgaggccaucuucaagcugaccuaccagaacaaggucgugcgcgugcagcggccgacgccccgggggaccgucauggacaucaucagccggcgcgaccagcggggcuccggccagguggggacguacggccugaacaccuucaccaacauggaggcccagcucauccgccagauggagggggagggcguguucaagaacauccagcaccugaccgucacggaggagguggccgugcagaacuggcuggcgcgggucgggcgcgagcgccucagccggauggccaucuccggcgacgacugcguggugaagccccuggacgaccgcuucgccaacgcccugaccgcccucaacgacaugggcaagauccggaaggacauccagcagugggagcccagcaagggguggaacgacuggacccaggucccguucugcucccaccacuuccacgagcugaucaugaaggacggccgcgugcuggugguccccugccggaaccaggacgagcucaucgggcgcgcgcggaucagccagggcgccggguggucccugcgcgagaccgccugccugggcaagagcuacgcccagauguggucccucauguacuuccaccggcgcgaccugcggcuggccgcgaacgccaucugcagcgccgugcccucccacugggugcccacgagccgcaccaccugguccauccacgccaagcacgaguggaugaccaccgaggacaugcucacggucuggaaccggguguggauccgcgagaacccguggauggaggacaagacccccguggagagcugggaggagauccccuaccugggcaagcgggaggaccaguggugcgggucccugaucggccucaccagccgcgccaccugggcgaagaacauccaggccgccaucaaccagguccggucccugaucgggaacgaggaguacacggacuacaugcccagcaugaagcgcuuccggcgcgaggaggaggaggccggcgugcugugguga

SEQ ID NO: 9612 - RNA, 9876 nt, Artificial Sequence
  derived and/or modified CDS sequence (opt1) from DENV-2__EU482467__SS-prME
agcgcgggcaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacaucaagacccggaccaacgacugggacuucguggugacgaccgacaucuccgagaugggcgccaacuucaaggcggagcgcgucaucgacccccggcgcugcaugaagcccgugauccucaccgacggggaggagcgggugauccuggccggccccaugccggucacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucguggaccucaugcggcgcggcgaccugcccgucuggcuggccuacaagguggccgcggaggggaucaacuacgccgaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccgugcugcacacggccgaggccggcgggcgggccuacaaccacgcccucuccgagcugcccgagacccuggagacccuccugcugcucacccugcuggccacggucaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacguggucaucgccauccugaccgugguggccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcggucgccaccaccuucgugacgcccaugcugcggcacagcaucgagaacagcuccgugaacgucagccucaccgccaucgccaaccaggccaccgugcugaugggccuggggaagggcuggccccucuccaagauggacaucggggugccgcugcuggcgaucggcugcuacagccaggucaaccccaucacccucacggccgcccugcugcuccugguggcccacuacgcgaucaucgggcccggccugcaggccaaggccacccgcgaggcccagaagcgggccgcggccggcaucaugaagaaccccaccguggacgggaucaccgucaucgaccucgacccgauccccuacgaccccaaguucgagaagcagcugggccaggugaugcugcucauccugugcgugacgcagguccugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacaugggcgagacgcugggcgagaaguggaagucccgccugaacgcccucgggaaguccgaguuccagaucuacaagaaguccggcauccaggagguggaccggacccuggcgaaggaggggaucaagcgcggcgagaccgaccaccacgccgucagccggggguccgccaagcugcgcugguucguggagcggaacauggugacccccgagggcaaggucguggaccucggcugcgggcgcggcggguggagcuacuacugcggcgggcugaagaacgugcgggaggucaagggccugacgaagggcgggcccggccacgaggagcccaucccgauguccaccuacggguggaaccucgugcgccugcagagcggcguggacgucuucuucaucccgcccgagaagugcgacacccugcucugcgacaucggggaguccagccccaacccgaccguggaggccggccggacgcugcgcgugcugaaccucgucgagaacuggcugaacaacaacacccaguucugcaucaaggugcugaaccccuacaugcccuccgugaucgagaagauggaggcgcugcagcggaaguacggcggggcccucguccgcaacccgcugagccggaacagcacccacgagauguacuggguguccaacgccagcggcaacaucguguccagcgucaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggugaacggcgucgugcggcugcucaccaagccgugggacgugcugcccaccgucacccagauggccaugacggacaccacccccuucgggcagcagcgcguguucaaggagaagguggacacccgcacgcaggagcccaaggagggcaccaagaagcugaugaagaucaccgccgaguggcucuggaaggagcugggcaagaagaagaccccgcggaugugcacgcgcgaggaguucacccggaagguccgcuccaacgccgcccugggggcgaucuucaccgacgagaacaaguggaaguccgcccgggaggccguggaggacucccgcuucugggagcucguggacaaggagcggaaccugcaccuggagggcaagugcgagaccugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgucagcaagaaggagggcggcgccauguacgccgacgacacggcggggugggacacccggaucacccucgaggaccugaagaacgaggagauggugaccaaccacauggagggcgagcaccgcaagcuggccgaggccaucuucaagcucacguaccagaacaaggugguccgggugcagcgccccacgccccgggggaccgugauggacaucaucagccgccgggaccagcgcggcuccgggcaggucggcaccuacggccugaacacguucaccaacauggaggcccagcugauccggcagauggagggggagggcguguucaagaacauccaccaccucaccgugaccgaggaggucgccgugcagaacuggcuggcgcgcguggggcgcgagcggcugagccgcauggccaucuccggcgacgacugcgucgugaagccccucgacgaccgguucgccaacgcccugacggcccugaacgacaugggcaagauccgcaaggacauccagcagugggagccgagcaagggguggaacgacuggacccaggugcccuucugcucccaccacuuccacgagcucaucaugaaggacggccggguccugguggugcccugccgcaaccaggacgagcugaucgggcgggcgcgcaucagccagggcgccggguggucccuccgggagaccgccugccugggcaagagcuacgcccagauguggucccugauguacuuccaccgccgggaccuccgccuggccgcgaacgccaucugcagcgccguccccucccacugggugccgaccagccggacgaccugguccauccacgccaagcacgaguggaugaccaccgaggacaugcugaccguguggaaccgcgucuggauccgggagaaccccuggauggaggacaagacgcccguggagagcugggaggagauccccuaccucggcaagcgcgaggaccaguggugcgggucccugaucggccugaccagccgggccaccugggcgaagaacauccaggccgccaucaaccaggugcgcucccucaucgggaacgaggaguacaccgacuacaugccgagcaugaagcgguuccgccgcgaggaggaggaggccggcguccugugguga

SEQ ID NO: 9613 - RNA, 9876 nt, Artificial Sequence
  derived and/or modified CDS sequence (opt1) from DENV-2__EU482468__SS-prME
agcgcggggaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggaucaugcggcacccgggcuucacgaucauggccgcgauccuggccuacaccaucgggaccacccacuuccagcgcguccugaucuucauccuccugacggccguggcccccuccaugaccaugcggugcaucggcaucagcaaccgcgacuucguggagggcgucuccgggggcagcuggguggacaucgugcuggagcacggguccugcgucaccaccauggcgaagaacaagcccacgcucgacuucgagcugaucaagaccgaggccaagcagcccgccacccugcggaaguacugcaucgaggccaagcucaccaacacgaccaccgagagccgcugccccacccagggcgagcccucccugaaggaggagcaggacaagcgguucgugugcaagcacagcaugguggaccgcggcugggggaacggcugcgggcuguucggcaagggcgggaucgucacgugcgccauguucacgugcaagaagaacauggagggcaagaucgugcagcccgagaaccucgaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccuggacuucaacgagauggugcuccugcagauggagaacaaggccuggcuggugcaccgccagugguuccucgaccugccccugcccuggcucccgggggccgacaagcaggaguccaacuggauccagaaggagacccuggucaccuucaagaacccccacgccaagaagcaggacguggucgugcugggcagccaggagggggcgaugcacacggcccucaccggcgccaccgagauccagaugagcuccgggaaccugcuguucaccggccaccucaagugccggcugcgcauggacaagcugcagcucaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccugggccggcucaucaccgugaacccgaucgugacggagaaggacucccccgucaacaucgaggccgagccgcccuucggggacagcuacaucaucaucggcguggagccggggcagcugaagcugaacugguucaagaagggcuccagcaucgggcagauguucgagaccaccaugcgcggcgcgaagcgcauggccauccucggcgacaccgccugggacuucgggucccugggcgggguguucacgagcaucggcaaggcccugcaccaggucuucggggccaucuacggcgcggccuucuccggcgugagcuggaccaugaagauccucaucggggugaucaucaccuggaucggcaugaacucccggagcaccucccugagcgucucccuggugcugguggggaucgucacgcucuaccugggcgugauggugcaggccgacagcgggugcgucguguccuggaagaacaaggagcugaagugcggcagcggcaucuucaucaccgacaacgugcacaccuggaccgagcaguacaaguuccagcccgagagccccuccaagcucgccagcgcgauccagaaggcccaggaggaggggaucugcggcauccgcuccgucacgcggcuggagaaccugauguggaagcagaucacccccgagcucaaccacauccuggccgagaacgaggugaagcugaccaucaugaccggggacauccgcggcaucaugcaggccgggaagcggagccuccgcccgcagcccacggagcugaaguacuccuggaagaccuggggcaaggccaagaugcugagcaccgaguccuacaaccagaccuuccucaucgacggccccgagacggcggagugcccgaacaccaaccgggccuggaacagccuggagguggaggacuacggguucggcgucuucaccaccaacaucuggcugaagcucaaggagaagcaggacgccuucugcgacuccaagcugaugagcgccgccaucaaggacaaccgcgcggugcacgccgacaugggguacuggauggaguccgcccugaacgacacguggaagaucgagaaggccagcuucaucgaggugaagaacugccacuggcccaagucccacacccucuggagcaacggcguccuggaguccgagaugaucauccccaagaaccuggccggccccgugagccagcacaacuaccggccgggguaccacacccagaucgcgggccccuggcaccucgggaagcuggagauggacuucgacuucugcgacggcaccaccgugaucgucacggaggacugcgggaaccgcggccccucccugcggaccaccaccgccagcggcaagcucaucacggaguggugcugccgcagcugcacccugcccccgcugcgguaccgcggggaggacggcugcugguacgggauggagauccggccccucaaggagaaggaggagaaccuggugaacucccuggugaccgccggccacgggcaggucgacaacuucagccucggcgugcugggcauggcccuguuccucgaggagaugcugcgcacccggguggggacgaagcacgcgauccugcucgucgccguguccuucgugacccugaucaccggcaacaugagcuucaaggaccuggggcgcgucguggugauggucggcgccaccauggccgacgacaucgggaugggcgugacguaccucgcccugcuggcggccuucaaggugcggcccaccuucgccgccggccuccugcugcgcaagcucaccuccaaggagcugaugaugaccacgaucgggaucguccugcucagccaguccaccauccccgagaccgugcuggagcugaccgacgcccucgcgcugggcaugauggugcugaagaucguccgcaacauggagaaguaccagcucgccgugacgaucauggccauccugugcgucccgaacgccgugauccugcagaacgccuggaaggugagcugcaccauccucgcggucguguccgugagcccccugcugcucaccuccagccagcagaagaccgacuggaucccccuggcccugacgaucaaggggcucaaccccaccgccaucuuccugaccacccugucccggacgaacaagaagcgcagcuggccgcucaacgaggccaucauggcggucggcaugguguccauccuggccagcucccugcucaagaacgacauccccaugaccggcccccugguggccgggggccugcucaccgucugcuacgugcugaccgggcggagcgccgaccuggagcucgagcgcgccacggacgugaagugggaggaccaggcggagaucuccggcagcagccccauccuguccaucaccaucagcgaggacggguccaugagcaucaagaacgaggaggaggagcagacccugaccauccucauccggacgggccugcuggucaucuccggccucuucccgaucagcauccccaucaccgccgccgccugguaccugugggaggugaagaagcagcgcgccggggugcugugggacguccccagcccgccgcccaugggcaaggcggagcucgaggacggggccuaccggaucaagcagaagggcauccugggguacagccagaucggcgccggcguguacaaggaggggaccuuccacaccauguggcacgugacccgcggcgccguccugaugcacaaggggaagcggaucgagcccuccugggccgacgugaagaaggaccucaucagcuacggcgggggcuggaagcuggagggcgaguggaaggagggggaggaggugcagguccuggcgcucgagcccggcaagaacccccgcgccgugcagacgaagcccgggcuguucaagaccaacaccggcaccaucggggccgugucccuggacuucagccccggcacguccggcagccccaucaucgacaagaaggggaaggucgugggccucuacgggaacggcguggucacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccugcccgccaucgugcgcgaggccaucaagcgggggcuccgcacccugauccuggcgccgacccgggucguggccgccgagauggaggaggcccuccgcggccugcccauccgguaccagacccccgccauccgcgcggagcacacggggcgcgagaucguggaccugaugugccacgccaccuucaccaugcggcuccugagccccguccgcgugccgaacuacaaccugaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagacggugugguucgugccgagcaucaaggcggggaacgacaucgccgccugccuccgcaagaacggcaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccugaccgacggggaggagcgcgucauccucgccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcugcucgacaacaucaacacgcccgagggcaucaucccgagcauguucgagcccgagcgggagaagguggacgccaucgacggcgaguaccgccugcgcggggaggcccggaagaccuucgucgaccugaugcgccggggcgaccuccccguguggcuggccuacaagguggccgcggaggggaucaacuacgccgaccgccgguggugcuucgacggcaucaagaacaaccagauccuggaggagaacgucgagguggagaucuggaccaaggagggggagcgcaagaagcucaagccgcgguggcuggacgcccgcaucuacuccgacccccuggcccucaaggaguucaaggaguucgccgcgggccggaagucccugacccugaaccucaucacggagaugggccgccugcccaccuucaugacccagaagacccgggacgcccuggacaaccucgccguccugcacacggccgaggccggcgggcgcgccuacaaccacgcccuguccgagcuccccgagacccuggagacccugcuccugcugacccuccuggccacggugaccgggggcaucuuccuguuccucaugagcggccgggggaucggcaagaugacccuggggaugugcugcaucaucaccgccuccacccugcucugguacgcgcagauccagccgcacuggaucgccgccagcaucauccuggaguucuuccugaucgugcuccugauccccgagcccgagaagcagcgcacgccccaggacaaccagcugaccuacgucgugaucgccauccucaccguggucgccgcgaccauggccaacgagaugggcuuccuggagaagacgaagaaggaccuggggcucggcuccaucgccacccagcagccggagagcaacauccuggacaucgaccugcggcccgccuccgccuggacccucuacgcgguggccaccacguucgugacccccaugcugcgccacagcaucgagaacagcuccgucaacgugagccugaccgccaucgccaaccaggccaccgugcucaugggccuggggaagggcuggccccuguccaagauggacaucggggucccgcuccuggcgaucggcugcuacagccaggugaaccccaucacgcugaccgccgcccuccugcugcucguggcccacuacgcgaucaucgggcccggccugcaggccaaggccacccgggaggcccagaagcgcgccgcggccggcaucaugaagaaccccaccgucgacgggaucacggugaucgaccuggacccgauccccuacgaccccaaguucgagaagcagcucggccaggugaugcugcugauccucugcgucacccaggugcugaugaugcggaccaccugggcccugugcgaggcccucacgcuggccaccgggcccaucuccacccugugggagggcaacccggggcgcuucuggaacaccacgaucgcggugagcauggccaacaucuuccggggcuccuaccucgccggcgccgggcugcuguucagcaucaugaagaacaccaccaacacccgccgcggcacggggaacaucggcgagacccucggcgagaaguggaagucccggcugaacgcccugggcaagagcgaguuccagaucuacaagaaguccggcauccaggaggucgaccgcacccucgcgaaggaggggaucaagcggggcgagaccgaccaccacgccgugagccgcggguccgccaagcugcggugguucguggagcgcaacauggucacgcccgagggcaaggugguggaccugggcugcgggcggggcggguggagcuacuacugcggcgggcucaagaacguccgcgaggugaagggccugaccaagggcgggcccggccacgaggagcccaucccgauguccaccuacggguggaaccuggugcggcuccagagcggcgucgacguguucuucaucccgcccgagaagugcgacacccugcugugcgacaucggggaguccagccccaacccgacgguggaggccggccgcacccuccggguccugaaccugguggagaacuggcucaacaacaacacccaguucugcaucaaggugcugaaccccuacaugcccuccgucaucgagaagauggaggcgcugcagcgcaaguacggcggggcccuggugcggaacccgcucagccgcaacagcacccacgagauguacuggguguccaacgccagcggcaacaucgucuccagcgugaacaugaucucccggaugcugaucaaccgcuucaccaugcggcacaagaaggccacguacgagcccgacguggaccuggggagcggcacccgcaacaucgggaucgaguccgagauccccaaccucgacaucaucggcaagcggaucgagaagaucaagcaggagcacgagaccagcuggcacuacgaccaggaccaccccuacaagaccugggccuaccacggcuccuacgagacgaagcagaccgggagcgcguccagcauggucaacggcguggugcgccugcugaccaagccgugggacguccuccccaccgugacgcagauggccaugaccgacaccacccccuucgggcagcagcgcguguucaaggagaaggucgacacgcggacccaggagcccaaggagggcaccaagaagcugaugaagaucaccgccgaguggcuguggaaggagcucggcaagaagaagacgccgcgcaugugcacccgggaggaguucacccgcaaggugcgguccaacgccgcccugggggcgaucuucaccgacgagaacaaguggaaguccgcccgcgaggccguggaggacucccgguucugggagcuggucgacaaggagcgcaaccuccaccuggagggcaagugcgagacgugcguguacaacaugauggggaagcgggagaagaagcugggcgaguucgggaaggccaagggcagccgcgccaucugguacauguggcucggcgcgcgguuccuggaguucgaggcccugggguuccucaacgaggaccacugguucucccgcgagaacagccuguccggcgucgagggggagggccugcacaagcucggguacauccugcgggacgugagcaagaaggagggcggcgccauguacgccgacgacaccgcggggugggacacccgcaucacccuggaggaccucaagaacgaggagauggugacgaaccacauggagggcgagcacaagaagcuggccgaggccaucuucaagcugaccuaccagaacaaggucgugcgggugcagcgccccacgccccgggggaccgucauggacaucaucagccgccgggaccagcgcggcuccggccaggugggcacguacggccucaacaccuucaccaacauggaggcccagcugauccggcagauggagggggagggcguguucaagaacauccagcaccugaccgucacggaggagguggccgugcacaacuggcucgcgcgcgucgggcgcgagcggcugagccgcauggccaucuccggcgacgacugcguggugaagccccuggacgaccgguucgccaacgcccucaccgcccugaacgacaugggcaagauccgcaaggacauccagcagugggagccgagcaagggguggaacgacuggacccagguccccuucugcucccaccacuuccacgagcugaucaugaaggacggccgggugcucgugguccccugccgcaaccaggacgagcugaucgggcgggcgcgcaucagccagggcgccggguggucccugcgggagaccgccugccucggcaagagcuacgcccagauguggucccugauguacuuccaccgccgggaccugcgccucgccgcgaacgccaucugcagcgccgugcccucccacugggugccgacgagccggaccaccugguccauccacgccaagcacgaguggaugaccaccgaggacaugcugacggucuggaaccgcguguggauccgggagaaccccuggauggaggacaagacccccguggagagcugggaggagauccccuaccugggcaagcgcgaggaccaguggugcgggucccucaucggccugaccagccgggccaccugggcgaagaacauccaggccgccaucaaccagguccgcucccugaucgggaacgaggaguacacggacuacaugccgagcaugaagcgguuccgccgcgaggaggaggaggccggcgugcucugguga

SEQ ID NO: 9614 - RNA, 9876 nt, Artificial Sequence
  derived and/or modified CDS sequence (opt1) from DENV-2__EU482469__SS-prME
agcgcggggaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggcccacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacauccgcggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggccaucauggcggucggcaugguguccauccuggccagcucccuccugaagaacgacauccccaugaccggcccccugguggccgggggccuccugaccgucugcuacgugcugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgucaucuccggccuguucccgaucagcauccccaucaccgccgccgccugguaccugugggaggugaagaagcagcgcgccggggugcucugggacguccccagcccgccgcccaugggcaaggcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgguccggcgccuacgugagcgccaucgcgcagaccgagaagaacaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccgggucguggccgccgagauggaggaggcccugcgcggccugcccauccgguaccagacccccgccauccgcgcggagcacacggggcgcgagaucguggaccucaugugccacgccaccuucaccaugcggcugcugucccccguccgcgugccgaacuacaaccucaucaucauggacgaggcccacuucaccgaccccgccagcaucgccgcgcggggcuacaucuccacgcgcguggagaugggcgaggccgccgggaucuucaugaccgccacgccgcccggcagccgggacccguucccccagagcaacgcccccaucaucgacgaggagcgcgagauccccgagcgguccuggaacagcgggcacgagugggucaccgacuucaagggcaagacggugugguucgugccguccaucaaggcggggaacgacaucgccgccugccugcgcaagaacggcaagaaggucauccagcugagccggaagaccuucgacuccgaguacgugaagacccgcaccaacgacugggacuucguggucacgaccgacaucagcgagaugggcgccaacuucaaggcggagcgggugaucgacccccgccggugcaugaagcccgugauccucaccgacggggaggagcgcgucauccuggccggccccaugccggugacccacuccagcgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccguccauguucgagcccgagcgggagaagguggacgccaucgacggcgaguaccgccugcgcggggaggcccggaagaccuucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacagcgacccccucgcccugaaggaguucaaggaguucgccgcgggccggaagucccugacccucaaccugaucacggagaugggccgccugcccaccuucaugacccagaagacccgggacgcccucgacaaccuggccguccugcacacggccgaggccggcgggcgcgccuacaaccacgcccucagcgagcugcccgagacccuggagacccuccugcugcucacccugcuggccacggugaccgggggcaucuuccucuuccugauguccggccgggggaucggcaagaugacccuggggaugugcugcaucaucaccgccagcauccuccugugguacgcgcagauccagccgcacuggaucgccgccuccaucauccuggaguucuuccucaucgugcugcugauccccgagcccgagaagcagcgcacgccccaggacaaccagcucacguacgucgugaucgccauccugaccguggucgccgcgaccauggccaacgagaugggcuuccuggagaagaccaagaaggaccucgggcugggcagcaucgccacgcagcagccggaguccaacauccuggacaucgaccuccggcccgccagcgccuggacccuguacgcgguggccaccaccuucgugacgcccaugcugcgccacuccaucgagaacagcagcgucaacgugucccucaccgccaucgccaaccaggccaccgugcugaugggccuggggaagggcuggccccucagcaagauggacaucggggucccgcugcuggcgaucggcugcuacucccaggugaaccccaucacccucacggccgcccugcugcuccugguggcccacuacgcgaucaucgggcccggccugcaggccaaggccacccgggaggcccagaagcgcgccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacggggcccaucagcacccucugggagggcaacccggggcgcuucuggaacaccaccaucgcgguguccauggccaacaucuuccggggcagcuaccuggccggcgccgggcuccucuucuccaucaugaagaacacgaccaacacccgccgcggcaccgggaacacgggcgagacccugggcgagaaguggaagucccggcugaacgcccucgggaaguccgaguuccagaucuacaagaaguccggcauccaggaggucgaccgcacccuggcgaaggaggggaucaagcggggcgagaccgaccaccacgccgugucccgcgggagcgccaagcugcggugguucguggagcgcaacauggucacgcccgagggcaaggugguggaccucggcugcgggcggggcgggugguccuacuacugcggcgggcugaagaacguccgcgaggugaagggccugaccaagggcgggcccggccacgaggagcccaucccgaugagcaccuacggguggaaccucgugcggcugcaguccggcgucgacguguucuucaucccgcccgagaagugcgacacccugcucugcgacaucggggagagcucccccaacccgacgguggaggccggccgcacccugcggguccugaaccucguggagaacuggcugaacaacaacacccaguucugcaucaaggugcugaaccccuacaugcccagcgucaucgagaagauggaggcgcugcagcgcaaguacggcggggcccucgugcggaacccgcugucccgcaacagcacccacgagauguacugggugagcaacgccuccggcaacaucgucagcuccgugaacaugaucagccggaugcugaucaaccgcuucaccaugcggcacaagaaggccacguacgagcccgacguggaccucggguccggcacccgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagacgaagcagaccggguccgcgagcuccauggucaacggcguggugcgccugcucaccaagccgugggacguccugcccaccgugacgcagauggccaugaccgacaccacccccuucgggcagcagcgcguguucaaggagaaggucgacacgcggacccaggagcccaaggagggcaccaagaagcugaugaagaucaccgccgaguggcucuggaaggagcugggcaagaagaagacgccgcgcaugugcacccgggaggaguucaccaagaaggugcgcagcaacgccgcccugggggcgaucuucaccgacgagaacaaguggaaguccgcccgggaggccguggaggacagccgcuucugggagcucgucgacaaggagcggaaccugcaccuggagggcaagugcgagacgugcguguacaacaugauggggaagcgcgagaagaagcucggcgaguucgggaaggccaagggcucccgggccaucugguacauguggcugggcgcgcgcuuccuggaguucgaggcccucggguuccugaacgaggaccacugguucagccgggagaacucccugagcggcgucgagggggagggccuccacaagcugggguacauccugcgcgacguguccaagaaggagggcggcgccauguacgccgacgacaccgcggggugggacacccggaucacccucgaggaccugaagaacgaggagauggugacgaaccacauggagggcgagcacaagaagcuggccgaggccaucuucaagcucaccuaccagaacaaggucgugcgcgugcagcggcccacgccccgcgggaccgucauggacaucaucagccggcgcgaccagcggggcagcggccaggugggcacguacggccugaacaccuucaccaacauggaggcccagcugauccgccagauggagggggagggcguguucaagaacauccagcaccucaccgucacggaggagguggccgugcacaacuggcuggcgcgggucgggcgcgagcgccugucccggauggccaucagcggcgacgacugcguggugaagccccucgacgaccgcuucgccaacgcccugaccgcccugaacgacaugggcaagauccggaaggacauccagcagugggagccguccaagggguggaacgacuggacccagguccccuucugcagccaccacuuccacgagcucaucaugaaggacggccgcauccugguggugcccugccggaaccaggacgagcugaucgggcgcgcgcggaucucccagggcgccggguggagccuccgcgagaccgccugccugggcaaguccuacgcccagauguggagccugauguacuuccaccggcgcgaccuccggcuggccgcgaacgccaucugcuccgccguccccagccacugggugccgacgucccgcaccaccuggagcauccacgccaagcacgaguggaugaccaccgaggacaugcugacgguguggaaccgggucuggauccgcgagaaccccuggauggaggacaagacccccguggaguccugggaggagauccccuaccucggcaagcgggaggaccaguggugcgggagccugaucggccugaccucccgcgccaccugggcgaagaacauccaggccgccaucaaccaggugcggagccucaucgggaacgaggaguacacggacuacaugccguccaugaagcgcuuccggcgcgaggaggaggaggccggcguccugugguga

SEQ ID NO: 9615 - RNA, 9876 nt, Artificial Sequence
  derived and/or modified CDS sequence (opt1) from DENV-2__EU482470__SS-prME
agcgccgggaugaucaucaugcugauccccaccgugauggccuuccaccucaccacccgcaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucaugaccauccugugcgucccgaacgccgugauccuccagaacgccuggaaggugagcugcaccauccuggccgucguguccgugagcccccugcuccugaccuccagccgccagaagacggacuggaucccccuggcgcucaccaucaaggggcugaaccccaccgccaucuuccugaccacgcucucccggaccaacaagaagcgcagcuggccgcugaacgaggccaucauggccgucggcaugguguccauccuggcgagcucccuccugaagaacgacauccccaugaccggcccccugguggccgggggccuccugaccgucugcuacgugcugacggggcggagcgccgaccucgagcuggagcgcgccaccgacgugaagugggaggaccaggccgagaucuccggcagcagccccauccuguccaucaccaucagcgaggacggguccaugagcaucaagaacgaggaggaggagcagacccucacgauccugauccggaccggccugcucgucaucuccggccuguucccgaucagcauccccaucaccgcggccgccugguaccugugggaggugaagaagcagcgcgccggggugcucugggacguccccagcccgccgcccaugggcaaggccgagcuggaggacggggcguaccggaucaagcagaagggcauccugggguacagccagaucggcgccggcguguacaaggaggggaccuuccacaccauguggcacgugacgcgcggcgccguccucaugcacaaggggaagcggaucgagcccuccugggccgacgugaagaaggaccugaucagcuacggcgggggcuggaagcuggagggcgaguggaaggagggggaggaggugcagguccucgcccuggagcccggcaagaacccccgcgcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgguccggcgccuacgugagcgccaucgcccagaccgagaaguccaucgaggacaaccccgagaucgaggacgacaucuuccgcaagcggcgccugacgaucauggaccugcaccccggggcgggcaagaccaagcgguaccuccccgccaucgugcgcgaggccaucaagcgggggcugcgcacccugauccucgccccgacccgggucguggcggccgagauggaggaggcccugcgcggccugcccauccgguaccagacgcccgccauccgcgccgagcacaccgggcgcgagaucguggaccucaugugccacgcgaccuucaccaugcggcugcugagccccguccgcgugccgaacuacaaccucaucaucauggacgaggcccacuucacggaccccgccuccaucgccgcccggggcuacaucagcacccgcguggagaugggcgaggcggccgggaucuucaugaccgccacgccgcccggcagccgggacccguucccccaguccaacgcccccaucaucgacgaggagcgcgagauccccgagcggagcuggaacuccgggcacgagugggucacggacuucaagggcaagaccgugugguucgugccgagcaucaaggccgggaacgacaucgcggccugccugcgcaagaacggcaagaaggucauccagcugucccggaagaccuucgacagcgaguacgugaagacccgcacgaacgacugggacuucguggucaccaccgacaucuccgagaugggcgccaacuucaaggccgagcgggugaucgacccccgccggugcaugaagcccgugauccucaccgacggggaggagcgcgucauccuggcgggccccaugccggugacgcacagcuccgccgcccagcggcgcgggcggaucggccgcaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgggagaagguggacgcgaucgacggcgaguaccgccugcgcggggaggcccggaagaccuucgucgaccucaugcgccggggcgaccugcccguguggcuggccuacaagguggccgccgaggggaucaacuacgcggaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgccggccggaagucccugacgcucaaccugaucaccgagaugggccgccugcccaccuucaugacccagaagacgcgggacgcgcucgacaaccuggccguccugcacaccgccgaggccgggggccgcgcguacaaccacgcccucuccgagcugcccgagacccuggagacccuccugcugcucacgcugcuggccaccgugaccgggggcaucuuccucuuccugaugagcggccgggggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcgcacgccccaggacaaccagcucaccuacgucgugaucgccauccugaccguggucgccgccaccauggcgaacgagaugggcuuccuggagaagacgaagaaggaccucgggcugggcuccaucgccacccagcagccggagagcaacauccuggacaucgaccuccggcccgccuccgccuggacccuguacgccguggcgaccacguucgugacccccaugcugcgccacagcaucgagaacagcuccgucaacgugagccucaccgccaucgccaaccaggccaccgugcugaugggccuggggaagggcuggccccucuccaagauggacaucggggucccgcugcuggccaucggcugcuacagccaggugaaccccaucacgcucaccgcggcccugcugcuccugguggcccacuacgccaucaucgggcccggccugcaggcgaaggccacccgggaggcccagaagcgcgccgccgcgggcaucaugaagaaccccaccgucgacgggaucacggugaucgaccucgacccgauccccuacgaccccaaguucgagaagcagcugggccaggugaugcugcucauccugugcgucacccaggugcugaugaugcggaccaccugggcccucugcgaggcccugacgcuggccaccgggcccaucuccacccucugggagggcaacccggggcgcuucuggaacaccacgaucgccgugagcauggcgaacaucuuccggggcuccuaccuggccggcgccgggcuccucuucagcaucaugaagaacaccaccaacacccgccgcggcacggggaacaugggcgagacccugggcgagaaguggaagucccggcugaacgcccucggcaagagcgaguuccagaucuacaagaaguccggcauccaggaggucgaccgcacccuggccaaggaggggaucaagcggggcgagaccgaccaccacgcggugagccgcggguccgccaagcugcggugguucguggagcgcaacauggucacgcccgagggcaaggugguggaccucggcugcgggcggggcggguggagcuacuacugcggcgggcugaagaacguccgcgaggugaagggccugaccaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgacgguggaggccggccgcacccugcggguccugaaccucguggagaacuggcugaacaacaacacccaguucugcaucaaggugcugaaccccuacaugcccuccgucaucgagaagauggaggcccugcagcgcaaguacggcggggcgcucgugcggaacccgcugagccgcaacagcacccacgagauguacuggguguccaacgccagcggcaacaucgucuccagcgugaacaugaucucccggaugcugaucaaccgcuucaccaugcggcacaagaaggccacguacgagcccgacguggaccucgggagcggcacccgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgccuccagcauggucaacggcguggugcgccugcucaccaagccgugggacguccugcccaccgugacgcagauggcgaugaccgacaccacccccuucgggcagcagcgcguguucaaggagaaggucgacacgcggacccaggagcccaaggagggcaccaagaagcugaugaagaucaccgccgaguggcucuggaaggagcugggcaagaagaagacgccgcgcaugugcacccgggaggaguucacccgcaaggugcgguccaacgccgcccugggggccaucuucaccgacgagaacaaguggaaguccgcgcgcgaggccguggaggacuccggcuucugggagcucgucgacaaggagcggaaccugcaccuggaggggaagugcgagacgugcguguacaacaugaugggcaagcgcgagaagaagcucggggaguucggcaaggccaagggcagccgggccaucugguacauguggcugggggcccgcuuccuggaguucgaggcgcucggcuuccugaacgaggaccacugguucucccgggagaacagccuguccggggucgagggcgaggggcuccacaagcugggcuacauccugcgcgacgugagcaagaaggagggcggggccauguacgccgacgacaccgccggcugggacacccggaucacccucgaggaccugaagaacgaggagauggugacgaaccacauggagggggagcacaagaagcuggcggaggccaucuucaagcucaccuaccagaacaaggucgugcgcgugcagcggcccacgccccggggcaccgucauggacaucaucagccggcgcgaccagcggggguccggccaggugggcacguacgggcugaacaccuucaccaacauggaggcccagcugauccgccagauggagggcgaggggguguucaagaacauccagcaccucaccgucacggaggagguggccgugcagaacuggcuggcccgggucggccgcgagcgccugagccggauggcgaucuccggcgacgacugcguggugaagccccucgacgaccgcuucgccaacgcccugaccgcccugaacgacauggggaagauccggaaggacauccagcagugggagccgagcaagggcuggaacgacuggacccagguccccuucugcucccaccacuuccacgagcucaucaugaaggacgggcgcgugcuggugguccccugccggaaccaggacgagcugaucggccgcgcccggaucagccagggggcgggcuggucccuccgcgagaccgccugccugggcaagagcuacgcccagauguggucccugauguacuuccaccggcgcgaccuccggcuggccgccaacgcgaucugcagcgccgugcccucccacugggugccgacgagccgcaccaccugguccauccacgccaagcacgaguggaugaccaccgaggacaugcugacggucuggaaccggguguggauccgcgagaaccccuggauggaggacaagacccccguggagagcugggaggagauccccuaccucgggaagcgggaggaccaguggugcggcucccugaucgggcugaccagccgcgccaccugggccaagaacauccaggcggccaucaaccagguccggucccucaucggcaacgaggaguacacggacuacaugccgagcaugaagcgcuuccggcgcgaggaggaggaggccggggugcugugguga

SEQ ID NO: 9616 - RNA, 9876 nt, Artificial Sequence
  derived and/or modified CDS sequence (opt1) from DENV-2__EU482471__SS-prME
agcgccgggaugaucaucaugcugauccccaccgugauggccuuccaccucaccacccgcaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacagcgugggcaacgacacggggaagcacggcauggagaucaaggugaccccgcaguccagcaucaccgaggcggagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggagagcaacuggauccagaaggagacccuggucaccuucaagaacccccacgccaagaagcaggacguggucgugcucggcagccaggagggggccaugcacacggcgcugaccggcgccaccgagauccagauguccagcgggaaccuccuguucaccggccaccugaagugccggcugcgcauggacaagcuccagcugaagggcauguccuacagcaugugcacggggaaguucaagguggucaaggagaucgccgagacccagcacggcaccaucgugauccgggugcaguacgagggggacggcucccccugcaagauccccuucgagaucauggaccuggagaagcgcuacguccucggccggcugaucaccgugaacccgaucgugacggagaaggacagccccgucaacaucgaggccgagccgcccuucggggacuccuacaucaucaucggcguggagccggggcagcugaagcucaacugguucaagaagggcagcuccaucgggcagauguucgagaccaccaugcgcggcgccaagcgcauggcgauccugggcgacaccgccugggacuucgggagccugggcgggguguucacguccaucggcaaggcccuccaccaggucuucggggccaucuacggcgccgcguucagcggcguguccuggaccaugaagauccugaucggggugaucaucaccuggaucggcaugaacagccgguccaccagccuguccgucagccuggugcucguggggaucgucacgcuguaccugggcgugauggugcaggccgacuccgggugcgucgugagcuggaagaacaaggagcucaagugcggcagcggcaucuucaucaccgacaacgugcacaccuggaccgagcaguacaaguuccagcccgagucccccagcaagcuggccuccgccauccagaaggcgcaggaggaggggaucugcggcauccgcagcgucacgcggcuggagaaccucauguggaagcagaucacccccgagcugaaccacauccuggccgagaacgaggugaagcucaccaucaugaccggggacauccgcggcaucaugcaggccgggaagcggucccugcgcccgcagcccacggagcugaaguacagcuggaagaccuggggcaaggccaagaugcucuccaccgagagcuacaaccagaccuuccugaucgacggccccgagacggccgagugcccgaacaccaaccgggcguggaacucccuggagguggaggacuacggguucggcgucuucaccaccaacaucuggcucaagcugaaggagaagcaggacgccuucugcgacagcaagcugauguccgccgccaucaaggacaaccgcgccgugcacgcggacaugggguacuggaucgagagcgcccucaacgacacguggaagaucgagaaggccuccuucaucgaggugaagaacugccacuggcccaagagccacacccugugguccaacggcguccuggagagcgagaugaucauccccaagaaccucgccggccccgugucccagcacaacuaccggccgggguaccacacccagaucgccggccccuggcaccuggggaagcuggagauggacuucgacuucugcgacggcaccaccgugaucgucacggaggacugcgggaaccgcggccccagccuccggaccaccaccgcgagcggcaagcugaucacggaguggugcugccgcuccugcacccugcccccgcuccgguaccgcggggaggacggcugcugguacgggauggagauccggccccugaaggagaaggaggagaaccuggugaacagccucgugaccgccggccacgggcaggucgacaacuucucccugggcgugcugggcauggcccucuuccuggaggagaugcugcgcacccggguggggacgaagcacgccauccuccuggucgcggugagcuucgugacccugaucaccggcaacauguccuucaaggaccucgggcgcgucguggugauggucggcgccaccauggccgacgacaucgggaugggcgugacguaccuggcccugcucgccgcguucaaggugcggcccaccuucgccgccggccugcugcuccgcaagcugaccagcaaggagcugaugaugaccacgaucgggaucguccuccugucccagagcaccauccccgagaccgugcuggagcucaccgacgcccuggcccugggcaugauggugcucaagaucguccgcaacauggagaaguaccagcuggcggugacgaucauggccauccugugcgucccgaacgccgugauccuccagaacgccuggaagguguccugcaccauccuggccgucgugagcgugagcccccugcuccugaccagcucccagcagaagaccgacuggaucccccuggcgcucacgaucaaggggcugaaccccaccgccaucuuccugaccacccucagccggacgaacaagaagcgcuccuggccgcugaacgaggccaucauggccgucggcauggugagcauccuggcguccagccuccugaagaacgacauccccaugaccggcccccugguggccgggggccuccugaccgucugcuacgugcugaccgggcgguccgccgaccucgagcuggagcgcgccacgaacgugaagugggaggaccaggccgagaucagcggcagcucccccauccugagcaucaccaucuccgaggacgggagcauguccaucaagaacgaggaggaggagcagacccucaccauccugauccggacgggccugcucgucaucagcggccuguucccgaucuccauccccaucaccgcggccgccugguaccugugggaggugaagaagcagcgcgccggggugcucugggacguccccuccccgccgcccaugggcaaggccgagcuggaggacggggcguaccggaucaagcagaagggcauccugggguacucccagaucggcgccggcguguacaaggaggggaccuuccacaccauguggcacgugacccgcggcgccguccucaugcacaaggggaagcggaucgagcccagcugggccgacgugaagaaggaccugaucuccuacggcgggggcuggaagcuggagggcgaguggaaggagggggaggaggugcagguccucgcccuggagcccggcaagaacccccgcgcggugcagacgaagcccgggcuguucaagaccaacaccggcaccaucggggccgugagccucgacuucucccccggcacgagcggcucccccaucaucgacaagaaggggaaggucgugggccuguacgggaacggcguggucacccggagcggcgccuacguguccgccaucgcccagaccgagaaguccaucgaggacaaccccgagaucgaggacgacaucuuccgcaagcggcgccugaccaucauggaccugcaccccggggcgggcaagacgaagcgguaccuccccgccaucgugcgcgaggccaucaagcgggggcugcgcacccugauccucgccccgacccgggucguggcggccgagauggaggaggcccugcgcggccugcccauccgguaccagacccccgccauccgcgccgagcacacggggcgcgagaucguggaccucaugugccacgcgaccuucaccaugcggcugcugucccccguccgcgugccgaacuacaaccucaucaucauggacgaggcccacuucaccgaccccgccagcaucgccgcccggggcuacaucagcacgcgcguggagaugggcgaggcggccgggaucuucaugaccgccacgccgcccggcucccgggacccguucccccagagcaacgcccccaucaucgacgaggagcgcgagauccccgagcgguccuggaacagcgggcacgagugggucaccgacuucaagggcaagacggugugguucgugccguccaucaaggccgggaacgacaucgcggccugccugcgcaagaacggcaagaaggucauccagcugagccggaagaccuucgacuccgaguacgugaagacccgcaccaacgacugggacuucguggucacgaccgacaucagcgagaugggcgccaacuucaaggccgagcgggugaucgacccccgccggugcaugaagcccgugauccucaccgacggggaggagcgcgucauccuggcgggccccaugccggugacccacuccagcgccgcccagcggcgcgggcggaucggccgcaaccccaagaacgagaacgaccaguacaucuacaugggggagccccuggagaacgacgaggacugcgcccacuggaaggaggccaagaugcuccuggacaacaucaacacgcccgagggcaucaucccguccauguucgagcccgagcgggagaagguggacgcgaucgacggcgaguaccgccugcgcggggaggcccggaagaccuucgucgaccucaugcgccggggcgaccugcccguguggcuggccuacaagguggccgccgaggggaucaacuacgcggaccgccgguggugcuucgacggcaucaagaacaaccagauccucgaggagaacgucgagguggagaucuggaccaaggagggggagcgcaagaagcugaagccgcgguggcuggacgcccgcaucuacagcgacccccucgcccugaaggaguucaaggaguucgccgccggccggaagucccugacccucaaccugaucacggagaugggccgccugcccaccuucaugacccagaagacccgggacgcgcucgacaaccuggccguccugcacacggccgaggccgggggccgcgcguacaaccacgcccucagcgagcugcccgagacccuggagacccuccugcugcucacccugcuggccacggugaccgggggcaucuuccucuuccugauguccggccgggggaucggcaagaugacccuggggaugugcugcaucaucaccgccagcauccuccugugguacgcccagauccagccgcacuggaucgcggccuccaucauccuggaguucuuccucaucgugcugcugauccccgagcccgagaagcagcgcacgccccaggacaaccagcucacguacgucgugaucgccauccugaccguggucgccgccaccauggcgaacgagaugggcuuccuggagaagaccaagaaggaccucgggcugggcagcaucgccacgcagcagccggaguccaacauccuggacaucgaccuccggcccgccagcgccuggacccuguacgccguggcgaccaccuucgugacgcccaugcugcgccacagcaucgagaacuccagcgucaacgugucccucaccgccaucgccaaccaggccaccgugcugaugggccuggggaagggcuggccccucagcaagauggacaucggggucccgcugcuggccaucggcugcuacucccaggugaaccccaucacccucacggcggcccugcugcuccugguggcccacuacgccaucaucgggcccggccugcaggcgaaggccacccgggaggcccagaagcgcgccgccgcgggcaucaugaagaaccccaccgucgacgggaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacggggcccaucagcacccucugggagggcaacccggggcgcuucuggaacaccaccaucgccguguccauggcgaacaucuuccggggcagcuaccuggccggcgccgggcuccucuucuccaucaugaagaacacgaccaacacccgccgcggcaccgggaacaucggcgagacgcugggcgagaaguggaagucccggcugaacgcccucgggaaguccgaguuccagaucuacaagaaguccggcauccaggaggucgaccgcacccuggccaaggaggggaucaagcggggcgagaccgaccaccacgcggugucccgcgggagcgccaagcugcggugguucguggagcgcaacauggucacccccgagggcaaggugguggaccucggcugcgggcggggcgggugguccuacuacugcggcgggcugaagaacguccgcgaggugaagggccugacgaagggcgggcccggccacgaggagcccaucccgaugagcaccuacggguggaaccucgugcggcugcaguccggcgucgacguguucuucaucccgcccgagaagugcgacacccugcucugcgacaucggggagagcucccccaacccgaccguggaggccggccgcacgcugcggguccugaaccucguggagaacuggcugaacaacaacacccaguucugcaucaaggugcugaaccccuacaugcccagcgucaucgagaagauggaggcccugcagcgcaaguacggcggggcgcucgugcggaacccgcugagccgcaacuccacccacgagauguacugggugagcaacgccuccggcaacaucgucagcuccgugaacaugaucagccggaugcugaucaaccgcuucaccaugcggcacaagaaggccaccuacgagcccgacguggaccucggguccggcacgcgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagaccaagcagacgggguccgccagcuccauggucaacggcguggugcgccugcucaccaagccgugggacguccugcccaccgugacccagauggcgaugacggacaccacccccuucgggcagcagcgcguguucaaggagaaggucgacacccggacgcaggagcccaaggagggcaccaagaagcugaugaagaucaccgccgaguggcucuggaaggagcugggcaagaagaagaccccgcgcaugugcacgcgggaggaguucacccgcaaggugcggagcaacgccgcccugggggccaucuucaccgacgagaacaaguggaaguccgcgcgcgaggccguggaggacagccgguucugggagcucgucgacaaggagcgcaaccugcaccuggagggcaagugcgagaccugcguguacaacaugauggggaagcgggagaagaagcucggcgaguucgggaaggccaagggcucccgcgccaucugguacauguggcugggcgcccgguuccuggaguucgaggcgcucggguuccugaacgaggaccacugguucagccgcgagaacucccugagcggcgucgagggggagggccuccacaagcugggguacauccugcgggacgugagcaagaaggagggcggcgccauguacgccgacgacacggccgggugggacacccgcaucacccucgaggaccugaagaacgaggagauggugaccaaccacauggagggcgagcacaagaagcuggcggaggccaucuucaagcucacguaccagaacaaggucgugcgggugcagcgccccacgccccgggggaccgucauggacaucaucucccgccgggaccagcgcggcagcggccaggugggcaccuacggccugaacacguucaccaacauggaggcccagcugauccggcagauggagggggagggcguguucaagaacauccagcaccucaccgucaccgaggagguggccgugcacaacuggcuggcccgcgucgggcgcgagcggcugucccgcauggcgaucagcggcgacgacugcguggugaagccccucgacgaccgguucgccaacgcccugacggcccugaacgacaugggcaagauccgcaaggacauccagcagugggagccguccaagggguggaacgacuggacccagguccccuucugcagccaccacuuccacgagcucaucaugaaggacggccggauccugguggugcccugccgcaaccaggacgagcugaucgggcgggcccgcaucucccagggcgcgggguggagccuccgggagaccgccugccugggcaaguccuacgcccagauguggagccugauguacuuccaccgccgggaccuccgccuggccgccaacgcgaucugcuccgccguccccagccacugggugccgaccucccggacgaccuggagcauccacgccaagcacgaguggaugaccaccgaggacaugcugaccguguggaaccgcgucuggauccgggagaaccccuggauggaggacaagacgcccguggaguccugggaggagauccccuaccucggcaagcgcgaggaccaguggugcgggagccugaucggccugaccucccgggccaccugggccaagaacauccaggcggccaucaaccaggugcgcagccucaucgggaacgaggaguacaccgacuacaugccgagcaugaagcgguuccgccgcgaggaggaggaggccggcguccugugguga

SEQ ID NO: 9617 - RNA, 9876 nt, Artificial Sequence
  derived and/or modified CDS sequence (opt1) from DENV-2__EU482472__SS-prME
agcgcggggaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacgcggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacauccgcggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggauggaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggccaucauggcggucggcaugguguccauccuggccagcucccuccugaagaacgacauccccaugaccggcccccugguggccgggggccuccugaccgucugcuacgugcugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgucaucuccggccuguucccgaucagcauccccaucaccgccgccgccugguaccugugggaggugaagaagcagcgcgccggggugcucugggacguccccagcccgccgcccaugggcaaggcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagacgaagcccgggcuguucaagaccaacaccggcaucaucggggccgugucccucgacuucagccccggcaccuccggcagccccaucaucgacaagaaggggaaggucgugggccuguacgggaacggcguggucacgcgguccggcgccuacgugagcgccaucgcgcagaccgagaaguccaucgaggacaaccccgagaucgaggacgacaucuuccgcaagcggcgccugaccaucauggaccugcaccccggggccggcaagaccaagcgguaccuccccgccaucgugcgcgaggccaucaagcgggggcugcgcacgcugauccucgcgccgacccgggucguggccgccgagauggaggaggcccugcgcggccugcccauccgguaccagacccccgccauccgcgcggagcacaccgggcgcgagaucguggaccucaugugccacgccacguucaccaugcggcugcugagccccguccgcgugccgaacuacaaccucaucaucauggacgaggcccacuucaccgaccccgccuccaucgccgcgcggggcuacaucagcacccgcguggagaugggcgaggccgccgggaucuucaugacggccacgccgcccggcagccgggacccguucccccaguccaacgcccccaucaucgacgaggagcgcgagauccccgagcggagcuggaacuccgggcacgagugggucaccgacuucaagggcaagaccgugugguucgugccgagcaucaaggcggggaacgacaucgccgccugccugcgcaagaacggcaagaaggucauccagcugucccggaagacguucgacagcgaguacgugaagacccgcaccaacgacugggacuucguggucaccacggacaucuccgagaugggcgccaacuucaaggcggagcgggugaucgacccccgccggugcaugaagcccgugauccucaccgacggggaggagcgcgucauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacccccgagggcaucaucccgagcauguucgagcccgagcgggagaagguggacgccaucgacggcgaguaccgccugcgcggggaggcccggaagacguucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgcgggccggaagucccugacccucaaccugaucaccgagaugggccgccugcccacguucaugacccagaagacccgggacgcccucgacaaccuggccguccugcacaccgccgaggccggcgggcgcgccuacaaccacgcccucuccgagcugcccgagacgcuggagacccuccugcugcucacccugcuggccaccgugaccggcgggaucuuccucuuccugaugagcgggcgggggaucgggaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucaccuacgucgugaucgccauccugacgguggucgccgcgaccauggccaacgagaugggcuuccuggagaagaccaagaaggaccucgggcugggcuccaucgccacccagcagccggagagcaacauccuggacaucgaccuccggcccgccuccgccuggacgcuguacgcgguggccaccaccuucgugacccccaugcugcgccacagcaucgagaacagcuccgucaacgugagccucacggccaucgccaaccaggccaccgugcugaugggccuggggaagggcuggccccucuccaagauggacaucggggucccgcugcuggcgaucggcugcuacagccaggugaaccccaucacccucaccgccgcccugcugcuccugguggcccacuacgcgaucaucgggcccggccugcaggccaaggccacgcgggaggcccagaagcgcgccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcggacgaccugggcccucugcgaggcccugacccuggccaccgggcccaucuccacgcucugggagggcaacccggggcgcuucuggaacaccaccaucgcggugagcauggccaacaucuuccggggcuccuaccuggccggcgccgggcuccucuucagcaucaugaagaacaccacgaacacccgccgcggcaccgggaacaucggcgagacccugggcgagaaguggaagucccggcugaacgcccucggcaagagcgaguuccagaucuacaagaaguccggcauccaggaggucgaccgcacgcuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggcccggccacgaggagcccaucccgauguccacguacggguggaaccucgugcggcugcagagcggcgucgacguguucuucaucccgcccgagaagugcgacacccugcucugcgacaucggggaguccagccccaacccgaccguggaggccggccgcacccugcggguccugaaccucguggagaacuggcugaacaacaacacgcaguucugcaucaaggugcugaaccccuacaugcccuccgucaucgagaagauggaggcgcugcagcgcaaguacggcggggcccucgugcggaacccgcugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacccgcaacaucgggaucgaguccgagauccccaaccuggacaucaucggcaagcggaucgagaagaucaagcaggagcacgagacgagcuggcacuacgaccaggaccaccccuacaagaccugggccuaccacggcuccuacgagaccaagcagaccgggagcgcguccagcauggucaacggcguggugcgccugcucacgaagccgugggacguccugcccaccgugacccagauggccaugaccgacacgacccccuucgggcagcagcgcguguucaaggagaaggucgacacccggacccaggagcccaaggagggcacgaagaagcugaugaagaucaccgccgaguggcucuggaaggagcugggcaagaagaagaccccgcgcaugugcacccgggaggaguucacgcgcaaggugcgguccaacgccgcccugggggcgaucuucaccgacgagaacaaguggaaguccgcccgcgaggccguggaggacucccgguucugggagcucgucgacaaggagcgcaaccugcaccuggagggcaagugcgagaccugcguguacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcgucgagggggagggccuccacaagcugggguacauccugcgggacgugagcaagaaggagggcggcgccauguacgccgacgacaccgcggggugggacacgcgcaucacccucgaggaccugaagaacgaggagauggugaccaaccacauggagggcgagcacaagaagcuggccgaggccaucuucaagcucaccuaccagaacaaggucgugcgggugcagcgccccacgccccgggggaccgucauggacaucaucagccgccgggaccagcgcggcuccggccaggugggcaccuacggccugaacaccuucacgaacauggaggcccagcugauccggcagauggagggggagggcguguucaagaacauccagcaccucaccgucaccgaggagguggccgugcacaacuggcuggcgcgcgucgggcgcgagcggcugagccgcauggccaucuccggcgacgacugcguggugaagccccucgacgaccgguucgccaacgcccugaccgcccugaacgacaugggcaagauccgcaaggacauccagcagugggagccgagcaagggguggaacgacuggacgcagguccccuucugcucccaccacuuccacgagcucaucaugaaggacggccgggugcuggugguccccugccgcaaccaggacgagcugaucgggcgggcgcgcaucagccagggcgccggguggucccuccgggagaccgccugccugggcaagagcuacgcccagauguggucccugauguacuuccaccgccgggaccuccgccuggccgcgaacgccaucugcagcgccgugcccucccacugggugccgaccagccggaccacgugguccauccacgccaagcacgaguggaugaccaccgaggacaugcugaccgucuggaaccgcguguggauccgggagaaccccuggauggaggacaagacccccguggagagcugggaggagauccccuaccucggcaagcgcgaggaccaguggugcgggucccugaucggccugacgagccgggccaccugggcgaagaacauccaggccgccaucaaccagguccgcucccucaucgggaacgaggaguacaccgacuacaugccgagcaugaagcgguuccgccgcgaggaggaggaggccggcgugcugugguga

SEQ ID NO: 9618 - RNA, 9876 nt, Artificial Sequence
  derived and/or modified CDS sequence (opt1) from DENV-2__EU482473__SS-prME
agcgcggggaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgaccgcaaggggaaggucgugggccuguacgggaacggcguggucacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccgggucguggccgccgagauggaggaggcccugcgcggccugcccauccgguaccagacccccgccauccgcgcggagcacacggggcgcgagaucguggaccucaugugccacgccaccuucaccaugcggcugcugagccccguccgcgugccgaacuacaaccucaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagacggugugguucgugccgagcaucaaggcggggaacgacaucgccgccugccugcgcaagaacggcaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccucaccgacggggaggagcgcgucauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaagguggacgccaucgacggcgaguaccgccugcgcggggaggcccggaagaccuucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccguccugcacacggccgaggccggcgggcgcgccuacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccggcccgccuccgccuggacccuguacgcgguggccaccaccuucgugacgcccaugcugcgccacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgggaggcccagaagcgcgccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcggaccaccugggcccucugcgaggcccugacccuggccacggggcccaucuccacccucugggagggcaacccggggcgcuucuggaacaccaccaucgcggugagcauggccaacaucuuccggggcuccuaccuggccggcgccgggcuccucuucagcaucaugaagaacacgaccaacacccgccgcggcaccgggaacaugggcgagacgcugggcgagaaguggaagucccggcugaacgcccucggcaagagcgaguuccagaucuacaagaaguccggcauccaggaggucgaccgcacccuggcgaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugacgaagggcgggcccggccacgaggagcccaucccgauguccaccuacggguggaaccucgugcggcugcagagcggcgucgacguguucuucaucccgcccgagaagugcgacacccugcucugcgacaucggggaguccagccccaacccgaccguggaggccggccgcacgcugcggguccugaaccucguggagaacuggcugaacaacaacacccaguucugcaucaaggugcugaaccccuacaugcccuccgucaucgagaagauggaggcgcugcagcgcaaguacggcggggcccucgugcggaacccgcugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacgcgcaacaucgggaucgaguccgagacccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgcguccagcauggucaacggcguggugcgccugcucaccaagccgugggacguccugcccaccgugacgcagauggccaugaccgacaccacccccuucgggcagcagcgcguguucaaggagaaggucgacacgcggacccaggagcccaaggagggcaccaagaagcugaugaagaucaccgccgaguggcucuggaaggagcugggcaagaagaagacgccgcgcaugugcacccgggaggaguucacccgcaaggugcgguccaacgccgcccugggggcgaucuucaccgacgagaacaaguggaaguccgcccgcgaggccguggaggacucccgguucugggagcucgucgacaaggagcgcaaccugcaccuggagggcaagugcgagacgugcguguacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcgucgagggggagggccuccacaagcugggguacauccugcgggacgugagcaagaaggagggcggcgccauguacgccgacgacaccgcggggugggacacccgcaucacccucgaggaccugaagaacgaggagauggugacgaaccacauggagggcgagcacaagaagcuggccgaggccaucuucaagcucaccuaccagaacaaggucgugcgggugcagcgccccacgccccgggggaccgucauggacaucaucagccgccgggaccagcgcggcuccggccagguggggacguacggccugaacaccuucaccaacauggaggcccagcugauccggcagauggagggggagggcguguucaagaacauccagcaccucaccgucacggaggagguggccgugcagaacuggcuggcgcgcgucgggcgcgagcggcugagccgcauggccaucuccggcgacgacugcguggugaagccccucgacgaccgguucgccaacgcccugaccgcccugaacgacaugggcaagauccgcaaggacauccagcagugggagccgagcaagggguggaacgacuggacccagguccccuucugcucccaccacuuccacgagcucaucaugaaggacggccgggugcuggugguccccugccgcaaccaggacgagcugaucgggcgggcgcgcaucagccagggcgccggguggucccuccgggagaccgccugccugggcaagagcuacgcccagauguggucccugauguacuuccaccgccgggaccuccgccuggccgcgaacgccaucugcagcgccgugcccucccacugggugccgacgagccggaccaccugguccauccacgccaagcacgaguggaugaccaccgaggacaugcugacggucuggaaccgcguguggauccgggagaaccccuggauggaggacaagacccccguggagagcugggaggagauccccuaccucggcaagcgcgaggaccaguggugcgggucccugaucggccugaccagccgggccaccugggcgaagaacauccaggucgccaucaaccaggugcgcucccucaucgggaacgaggaguacacggacuacaugccgagcaugaagcgguuccgccgcgaggaggaggaggccggcgugcugugguga

SEQ ID NO: 9619 - RNA, 9876 nt, Artificial Sequence
  derived and/or modified CDS sequence (opt1) from DENV-2__EU482474__SS-prME
agcgcggggaugaucaucaugcugauccccaccgugauggccuuccaccucaccacccgcaacggggagccccacaugaucguggggauccaggagaaggggaagucccugcuguucaagaccgaggacggggugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccaucaacaucgaggccgagccgcccuucggggacagcuacaucaucaucggcgucgagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccagguguucggggccaucuacggcgcggccuucuccggcgucagcuggaccaugaagauccugaucggggugaucaucaccuggaucggcaugaacucccggagcaccucccugagcgugucccugguccucguggggaucgugacgcuguaccugggcgucauggugcaggccgacagcgggugcguggucuccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggucaagcucaccaucaugaccggggacaucaagggcaucaugcaggccgggaagcgcagccugcggccgcagcccacggagcugaaguacuccuggaagaccuggggcaaggccaagaugcucagcaccgagucccacaaccagaccuuccugaucgacggccccgagacggcggagugcccgaacaccaaccgcgccuggaacagccuggagguggaggacuacggguucggcguguucaccaccaacaucuggcuccggcugaaggagaagcaggacgccuucugcgacuccaagcugaugagcgccgccaucaaggacaaccgcgcgguccacgccgacaugggguacuggaucgaguccgcccucaacgacacguggaagaucgagaaggccagcuucaucgaggugaagaacugccacuggcccaagucccacacccuguggagcaacggcgugcuggaguccgagaugaucauccccaagaaccucgccggccccgucagccagcacaacuaccggccgggguaccacacccagaucgcgggccccuggcaccuggggaagcuggagauggacuucgacuucugcgacggcaccaccgugaucgugacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggucaacucccucgugaccgccggccacggccagguggacaacuucagccugggcguccugggcauggcccucuuccuggaggagaugcugcgcacccggguggggacgaagcacgcgauccuccugguggccgucuccuucgugacccugaucaccggcaacaugagcuucaaggaccucgggcgcguggucgugauggugggcgccaccauggccgacgacaucgggaugggcgucacguaccuggcccugcucgcggccuucaaggugcggcccaccuucgccgccggccugcugcuccgcaagcugaccuccaaggagcugaugaugaccacgaucgggaucgugcuccugagccaguccaccauccccgagaccguccuggagcucaccgacgcccuggcgcugggcaugauggugcucaagaucgugcgcaacauggagaaguaccagcuggccgucacgaucauggccauccugugcgugccgaacgccgucauccuccagaacgccuggaaggugagcugcaccauccuggcgguggucuccgugagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggccaucauggcggugggcauggucuccauccuggccagcucccuccugaagaacgacauccccaugaccggcccccugguggccgggggccuccugaccgugugcuacguccugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgugaucuccggccuguucccgaucagcauccccaucaccgccgccgccugguaccugugggaggucaagaagcagcgcgccggggugcucugggacgugcccagcccgccgcccaugggcaaggcggagcuggaggacggggccuaccggaucaagcagaagggcauccugggguacagccagaucggcgccggcgucuacaaggaggggaccuuccacaccauguggcacgugacccgcggcgccgugcucaugcacaaggggaagcggaucgagcccuccugggccgacgucaagaaggaccugaucagcuacggcgggggcuggaagcuggagggcgaguggaaggagggggaggagguccaggugcucgcgcuggagcccggcaagaacccccgcgccguccagacgaagcccgggcuguucaagaccaacaccggcaccaucggggccgugucccucgacuucagccccggcacguccggcagccccaucaucgacaagaaggggaagguggucggccuguacgggaacggcguggugacccgguccggcgccuacgucagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccggguggucgccgccgagauggaggaggcccugcgcggccugcccauccgguaccagacccccgccauccgcgcggagcacacggggcgcgagaucguggaccucaugugccacgccaccuucaccaugcggcugcugagccccgugcgcgucccgaacuacaaccucaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggugaccgacuucaagggcaagacggucugguucgugccgagcaucaaggcggggaacgacaucgccgccugccugcgcaagaacggcaagaaggugauccagcugucccggaagaccuucgacagcgaguacgucaagacccgcaccaacgacugggacuucguggugacgaccgacaucuccgagaugggcgccaacuucaaggcggagcgggucaucgacccccgccggugcaugaagcccgugauccucaccgacggggaggagcgcgugauccuggccggccccaugccggucacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaagguggacgccguggacggcgaguaccgccugcgcggggaggcccggaagaccuucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccguccugcacacggccgaggccggcgggcgcgccuacaaccacgcccucuccgagcugcccgagacccuggagacccuccugcugcucacccugcuggccacggugaccgggggcaucuuccucuuccugaugagcggccgggggaucggcaagaugacccuggggaugugcugcaucgugaccgccuccauccuccugugguacgcgcagauccagccgcacuggaucgccgccagcaucauccuggaguucuuccucaucguccugcugauccccgagcccgagaagcagcgcacgccccaggacaaccagcucacguacguggugaucgccauccugaccgucguggccgcgaccauggccaacgagaugggcuuccuggagaagaccaagaaggaccucgggcugggcuccaucgccacgcagcagccggagagcaacauccuggacaucgaccuccggcccgccuccgccuggacccuguacgcgguggccaccaccuucgucacgcccaugcugcgccacagcaucgagaacagcuccgugaacgugagccucaccgccaucgccaaccaggccaccguccugaugggccuggggaagggcuggccccucuccaagauggacaucggggugccgcugcuggcgaucggcugcuacagccaggugaaccccaucacccucacggccgcccugcugcuccuggucgcccacuacgcgaucaucgggcccggccugcaggccaaggccacccgggaggcccagaagcgcgccgcggccggcaucaugaagaaccccaccguggacgggaucaccgugaucgaccucgacccgauccccuacgaccccaaguucgagaagcagcugggccaggucaugcugcucauccugugcgugacccaggugcugaugaugcggaccaccugggcccucugcgaggcccugacccuggccacggggcccaucuccacccucugggagggcaacccggggcgcuucuggaacaccaccaucgcggucagcauggccaacaucuuccggggcuccuaccuggccggcgccgggcuccucuucagcaucaugaagaacacgaccaacacccgccgcggcaccgggaacaugggcgagacgcugggcgagaaguggaagucccggcugaacgcccucggcaagagcgaguuccagaucuacaagaaguccggcauccaggagguggaccgcacccuggcgaaggaggggaucaagcggggcgagaccgaccaccacgccgugagccgcggguccgccaagcugcggugguucgucgagcgcaacauggugacccccgagggcaagguggucgaccucggcugcgggcggggcggguggagcuacuacugcggcgggcugaagaacgugcgcgaggugaagggccugacgaagggcgggcccggccacgaggagcccaucccgauguccaccuacggguggaaccucguccggcugcagagcggcguggacguguucuucaucccgcccgagaagugcgacacccugcucugcgacaucggggaguccagccccaacccgaccgucgaggccggccgcacgcugcgggugcugaaccucguggagaacuggcugaacaacaacacccaguucugcaucaagguccugaaccccuacaugcccuccgugaucgagaagauggaggcgcugcagcgcaaguacggcggggcccucgugcggaacccgcugagccgcaacagcacccacgagauguacugggucuccaacgccagcggcaacaucguguccagcgugaacaugaucucccggaugcugaucaaccgcuucaccaugcggcacaagaaggccaccuacgagcccgacgucgaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgcguccagcauggugaacggcgugguccgccugcucaccaagccgugggacgugcugcccaccgugacccagauggccaugacggacaccacccccuucgggcagcagcgcgucuucaaggagaagguggacacccggacgcaggagcccaaggagggcaccaagaagcugaugaagaucaccgccgaguggcucuggaaggagcugggcaagaagaagaccccgcgcaugugcacgcgggaggaguucacccgcaaggugcgguccaacgccgcccugggggcgaucuucaccgacgagaacaaguggaaguccgcccgcgaggccgucgaggacucccgguucugggagcucguggacaaggagcgcaaccugcaccuggagggcaagugcgagaccugcgucuacaacaugauggggaagcgggagaagaagcucggcgaguucgggaaggccaagggcagccgcgccaucugguacauguggcugggcgcgcgguuccuggaguucgaggcccucggguuccugaacgaggaccacugguucucccgcgagaacagccuguccggcguggagggggagggccuccacaagcugggguacauccugcgggacgugagcaagaaggagggcggcgccauguacgccgacgacacggcggggugggacacccgcaucacccucgaggaccugaagaacgaggagauggucaccaaccacauggagggcgagcacaagaagcuggccgaggccaucuucaagcucacguaccagaacaagguggugcggguccagcgccccacgccccgggggaccgugauggacaucaucagccgccgggaccagcgcggcuccggccaggugggcaccuacggccugaacacguucaccaacauggaggcccagcugauccggcagauggagggggagggcgucuucaagaacauccagcaccucaccgugaccgaggagguggccguccagaacuggcuggcgcgcguggggcgcgagcggcugagccgcauggccaucuccggcgacgacugcguggucaagccccucgacgaccgguucgccaacgcccugacggcccugaacgacaugggcaagauccgcaaggacauccagcagugggagccgagcaagggguggaacgacuggacccaggugcccuucugcucccaccacuuccacgagcucaucaugaaggacggccgggugcuggucgugcccugccgcaaccaggacgagcugaucgggcgggcgcgcaucagccagggcgccggguggucccuccgggagaccgccugccugggcaagagcuacgcccagauguggucccugauguacuuccaccgccgggaccuccgccuggccgcgaacgccaucugcagcgccgugcccucccacugggucccgaccagccggacgaccugguccauccacgccaagcacgaguggaugaccaccgaggacaugcugaccguguggaaccgcguguggauccgggagaaccccuggauggaggacaagacgcccgucgagagcugggaggagauccccuaccucggcaagcgcgaggaccaguggugcgggucccugaucggccugaccagccgggccaccugggcgaagaacauccaggccgccaucaaccaggugcgcucccucaucgggaacgaggaguacaccgacuacaugccgagcaugaagcgguuccgccgcgaggaggaggaggccggcgugcugugguga

SEQ ID NO: 9620 - RNA, 9876 nt, Artificial Sequence
  derived and/or modified CDS sequence (opt1) from DENV-2__EU482475__SS-prME
agcgccgggaugaucaucaugcugauccccaccgugauggccuuccaccucaccacccggaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgucgaccggcgcuggugcuucgacggcaucaagaacaaccagauccucgaggagaacguggaggucgagaucuggaccaaggagggggagcggaagaagcugaagccgcgcuggcuggacgcccggaucuacuccgacccccucgcccugaaggaguucaaggaguucgccgccggccgcaagagccugacccucaaccugaucacggagaugggccggcugcccaccuucaugacccagaagacccgcgacgcgcucgacaaccuggccgugcugcacacggccgaggccgggggccgggcguacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucacguacguggugaucgccauccugaccgucguggccgccaccauggcgaacgagaugggcuuccuggagaagaccaagaaggaccucgggcugggcuccaucgccacgcagcagccggagagcaacauccuggacaucgaccuccgccccgccuccgccuggacccuguacgccguggcgaccaccuucgucacgcccaugcugcggcacagcaucgagaacagcuccgugaacgugagccucaccgccaucgccaaccaggccaccguccugaugggccuggggaagggcuggccccucuccaagauggacaucggggugccgcugcuggccaucggcugcuacagccaggugaaccccaucacccucacggcggcccugcugcuccuggucgcccacuacgccaucaucgggcccggccugcaggcgaaggccacccgcgaggcccagaagcgggccgccgcgggcaucaugaagaaccccaccguggacgggaucaccgugaucgaccucgacccgauccccuacgaccccaaguucgagaagcagcugggccaggucaugcugcucauccugugcgugacccaggugcugaugaugcgcaccaccugggcccucugcgaggcccugacccuggccacggggcccaucuccacccucugggagggcaacccggggcgguucuggaacaccaccaucgccgucagcauggcgaacaucuuccgcggcuccuaccuggccggcgccgggcuccucuucagcaucaugaagaacacgaccaacacccggcgcggcaccgggaacaugggcgagacgcugggcgagaaguggaagucccgccugaacgcccucgggaaguccgaguuccagaucuacaagcgguccggcauccaggagguggaccgcacccuggccaaggaggggaucaagcggggcgagaccgaccaccacgcggugagccgcggguccgccaagcugcggugguucgucgagcgcaacauggugacccccgagggcaagguggucgaccucggcugcgggcggggcggguggagcuacuacugcggcgggcugaagaacgugcgcgaggugaagggccugacgaagggcgggcccggccacgaggagcccaucccgauguccaccuacggguggaaccucguccggcugcagagcggcguggacguguucuucaucccgcccgagaagugcgacacccugcucugcgacaucggggaguccagccccaacccgaccgucgaggccggccgcacgcugcgggugcugaaccucguggagaacuggcugaacaacaacacccaguucugcaucaagguccugaaccccuacaugcccuccgugaucgagaagauggaggcccugcagcgcaaguacggcggggcgcucgugcggaacccgcugagccgcaacagcacccacgagauguacugggucuccaacgccagcggcaacaucguguccagcgugaacaugaucucccggaugcugaucaaccgcuucaccaugcggcacaagaaggccaccuacgagcccgacgucgaccucgggagcggcacgcgcaacaucgggaucgaguccgagauccccaaccuggacaucaucggcaagcggaucgagaagaucaagcaggagcacgagaccagcuggcacuacgaccaggaccaccccuacaagaccugggccuaccacggcuccuacgagaccaagcagacggggagcgccuccagcauggugaacggcgugguccgccugcucaccaagccgugggacgugcugcccaccgugacccagauggcgaugacggacaccacccccuucgggcagcagcgcgucuucaaggagaagguggacacccggacgcaggagcccaaggagggcaccaagaagcugaugaagaucaccgccgaguggcucuggaaggagcugggcaagaagaagaccccgcgcaugugcacgcgggaggaguucacccgcaaggugcgguccaacgccgcccugggggccaucuucaccgacgagaacaaguggaaguccgcgcgcgaggccgucgaggacucccgguucugggagcucguggacaaggagcgcaaccugcaccuggagggcaagugcgagaccugcgucuacaacaugauggggaagcgggagaagaagcucggcgaguucgggaaggccaagggcagccgcgccaucugguacauguggcugggcgcccgguuccuggaguucgaggcgcucggguuccugaacgaggaccacugguucucccgcgagaacagccuguccggcguggagggggagggccuccacaagcugggguacauccugcgggacgugagcaagaaggagggcggcgccauguacgccgacgacacggccgggugggacacccgcaucacccucgaggaccugaagaacgaggagauggucaccaaccacaugaagggcgagcacaagaagcuggcggaggccaucuucaagcucacguaccagaacaagguggugcggguccagcgccccacgccccgggggaccgugauggacaucaucagccgccgggaccagcgcggcuccggccagguggggaccuacggccugaacacguucaccaacauggaggcccagcugauccggcagauggagggggagggcgucuucaagaacauccagcaccucaccgugaccgaggagguggccguccagaacuggcuggcccgcguggggcgcgagcggcugagccgcauggcgaucuccggcgacgacugcguggucaagccccucgacgaccgguucgccaacgcccugacggcccugaacgacaugggcaagauccgcaaggacauccagcagugggagccgagcaagggguggaacgacuggacccaggugcccuucugcucccaccacuuccacgagcucaucaugaaggacggccgggugcuggucgugcccugccgcaaccaggacgagcugaucgggcgggcccgcaucagccagggcgcgggguggucccuccgggagaccgccugccugggcaagagcuacgcccagauguggucccugauguacuuccaccgccgggaccuccgccuggccgccaacgcgaucugcagcgccgugcccucccacugggucccgaccagccggacgaccugguccauccacgccaagcacgaguggaugaccaccgaggacaugcugaccguguggaaccgcguguggauccgggagaaccccuggauggaggacaagacgcccgucgagagcugggaggagauccccuaccucggcaagcgcgaggaccaguggugcgggucccugaucggccugaccagccgggccaccugggccaagaacauccaggcggccaucaaccaggugcgcucccucaucgggaacgaggaguacaccgacuacaugccgagcaugaagcgguuccgccgcgaggaggaggaggccggcgugcugugguga

SEQ ID NO: 9621 - RNA, 9876 nt, Artificial Sequence
  derived and/or modified CDS sequence (opt1) from DENV-2__EU482541__SS-prME
agcgcggggaugaucaucaugcugauccccaccgugauggccuuccaccucaccacccgcaacggggagccccacaugaucgucgggauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacgcggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcauggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacauccgcggcaucaugcaggccgggaagcggagccugcgcccgcagcccgccgagcugaaguacuccuggaagacguggggcaaggcgaagaugcucagcaccgaguccuacaaccagaccuuccugaucgacggccccgagaccgccgagugcccgaacacgaaccgggccuggaacagccuggagguggaggacuacggguucggcgucuucaccaccaacaucuggcucaagcugaaggagaagcaggacgccuucugcgacuccaagcugaugagcgccgcgaucaaggacaaccgcgccgugcacgccgacaugggguacuggaucgaguccgcccucaacgacaccuggaagaucgagaaggccagcuucaucgaggugaagaacugccacuggcccaagucccacacgcuguggagcaacggcguccuggaguccgagaugaucauccccaagaaccucgcgggccccgugagccagcacaacuaccggccgggguaccacacccagaucgccggccccuggcaccuggggaagcuggagauggacuucgacuucugcgacggcaccaccgugaucgucaccgaggacugcgggaaccgcggccccucccuccggacgaccaccgccagcggcaagcugaucaccgaguggugcugccgcagcugcacgcugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggaccaagcacgccauccuccuggucgccguguccuucgugacgcugaucaccggcaacaugagcuucaaggaccucgggcgcgucguggugauggucggcgccaccauggccgacgacaucgggaugggcgugaccuaccuggcgcugcucgccgccuucaaggugcggcccacguucgccgccggccugcugcuccgcaagcugaccuccaaggagcugaugaugaccaccaucgggaucguccuccugagccaguccacgauccccgagaccgugcuggagcucaccgacgcgcuggcccugggcaugauggugcucaagaucguccgcaacauggagaaguaccagcuggccgugaccaucauggccauccugugcgucccgaacgccgugauccuccagaacgcguggaaggugagcugcacgauccuggccgucguguccgugagcccccugcuccugaccuccagccagcagaagaccgacuggaucccccuggcccucaccaucaaggggcugaaccccacggccaucuuccugaccacccucucccggaccaacaagaagcgcagcuggccgcugaacgaggcgaucauggccgucggcaugguguccauccuggccagcucccuccugaagaacgacauccccaugacgggcccccugguggccgggggccuccugaccgucugcuacgugcugaccgggcggagcgccgaccucgagcuggagcgcgcgaccgacgugaagugggaggaccaggccgagaucuccggcagcagccccauccuguccaucacgaucagcgaggacggguccaugagcaucaagaacgaggaggaggagcagacccucaccauccugauccggaccggccugcucgucaucuccggccuguucccgaucagcauccccaucacggccgccgccugguaccugugggaggugaagaagcagcgcgcgggggugcucugggacguccccagcccgccgcccaugggcaaggccgagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggcggacgugaagaaggaccugaucagcuacggcgggggcuggaagcuggagggcgaguggaaggagggggaggaggugcagguccucgcccuggagcccggcaagaacccccgcgccgugcagaccaagcccgggcuguucaagacgaacaccggcaccaucggggccgugucccucgacuucagccccggcaccuccggcagccccaucaucgacaagaaggggaaggucgugggccuguacgggaacggcguggucacgcgguccggcgccuacgugagcgcgaucgcccagaccgagaaguccaucgaggacaaccccgagaucgaggacgacaucuuccgcaagcggcgccugaccaucauggaccugcaccccggggccggcaagaccaagcgguaccuccccgccaucgugcgcgaggcgaucaagcgggggcugcgcacgcugauccucgccccgacccgggucguggccgccgagauggaggaggcccugcgcggccugcccauccgguaccagacccccgcgauccgcgccgagcacaccgggcgcgagaucguggaccucaugugccacgccacguucaccaugcggcugcugagccccguccgcgugccgaacuacaaccucaucaucauggacgaggcccacuucaccgaccccgccuccaucgcggcccggggcuacaucagcacccgcguggagaugggcgaggccgccgggaucuucaugacggccacgccgcccggcagccgggacccguucccccaguccaacgcgcccaucaucgacgaggagcgcgagauccccgagcggagcuggaacuccgggcacgagugggucaccgacuucaagggcaagaccgugugguucgugccgagcaucaaggccgggaacgacaucgccgccugccugcgcaagaacggcaagaaggucauccagcugucccggaagacguucgacagcgaguacgugaagacccgcaccaacgacugggacuucguggucaccacggacaucuccgagaugggcgcgaacuucaaggccgagcgggugaucgacccccgccggugcaugaagcccgugauccucaccgacggggaggagcgcgucauccuggccggccccaugccggugacccacagcuccgccgcccagcggcgcgggcggaucggccgcaaccccaagaacgagaacgaccaguacaucuacaugggggagccccuggagaacgacgaggacugcgcgcacuggaaggaggccaagaugcuccuggacaacaucaacacccccgagggcaucaucccgagcauguucgagcccgagcgggagaagguggacgccaucgacggcgaguaccgccugcgcggggaggcccggaagacguucgucgaccucaugcgccggggcgaccugcccguguggcuggccuacaagguggcggccgaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgcggccggccggaagucccugacccucaaccugaucaccgagaugggccgccugcccacguucaugacccagaagacccgggacgcccucgacaaccuggccguccugcacaccgcggaggccgggggccgcgccuacaaccacgcccucuccgagcugcccgagacgcuggagacccuccugcugcucacccugcuggccaccgugaccggcgggaucuuccucuuccugaugagcgggcgggggaucggcaagaugacccuggggaugugcugcaucaucaccgcguccauccuccugugguacgcccagauccagccgcacuggaucgccgccagcaucauccuggaguucuuccucaucgugcugcugauccccgagcccgagaagcagcgcacgccccaggacaaccagcucaccuacgucgugaucgccauccugacgguggucgcggccaccauggccaacgagaugggcuuccuggagaagaccaagaaggaccucgggcugggcuccaucgccacccagcagccggagagcaacauccuggacaucgaccuccggcccgccuccgcguggacgcuguacgccguggccaccaccuucgugacccccaugcugcgccacagcaucgagaacagcuccgucaacgugagccucacggccaucgccaaccaggcgaccgugcugaugggccuggggaagggcuggccccucuccaagauggacaucggggucccgcugcuggccaucggcugcuacagccaggugaaccccaucacccucaccgccgcccugcugcuccugguggcgcacuacgccaucaucgggcccggccugcaggccaaggccacgcgggaggcccagaagcgcgcggccgccggcaucaugaagaaccccaccgucgacgggaucaccgugaucgaccucgacccgauccccuacgaccccaaguucgagaagcagcugggccaggugaugcugcucauccugugcgucacccaggugcugaugaugcggacgaccugggcccucugcgaggcccugacccuggcgaccgggcccaucuccacgcucugggagggcaacccggggcgcuucuggaacaccaccaucgccgugagcauggccaacaucuuccggggcuccuaccuggccggcgccgggcuccucuucagcaucaugaagaacaccacgaacacccgccgcggcaccgggaacaucggcgagacccugggcgagaaguggaagucccggcugaacgcgcucggcaagagcgaguuccagaucuacaagaaguccggcauccaggaggucgaccgcacgcuggccaaggaggggaucaagcggggcgagaccgaccaccacgccgugagccgcggguccgccaagcugcggugguucguggagcgcaacauggucacccccgagggcaaggugguggaccucggcugcgggcggggcggguggagcuacuacugcggcgggcugaagaacguccgcgaggugaagggccugaccaagggcgggcccggccacgaggagcccaucccgauguccacguacggguggaaccucgugcggcugcagagcggcgucgacguguucuucaucccgcccgagaagugcgacacccugcucugcgacaucggggaguccagccccaacccgaccguggaggcgggccgcacccugcggguccugaaccucguggagaacuggcugaacaacaacacgcaguucugcaucaaggugcugaaccccuacaugcccuccgucaucgagaagauggaggcccugcagcgcaaguacggcggggcccucgugcggaacccgcugagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccucgggagcggcacccgcaacaucgggaucgaguccgagauccccaaccuggacaucaucggcaagcggaucgagaagaucaagcaggagcacgagacgagcuggcacuacgaccaggaccaccccuacaagaccugggcguaccacggcuccuacgagaccaagcagaccgggagcgccuccagcauggucaacggcguggugcgccugcucacgaagccgugggacguccugcccaccgugacccagauggccaugaccgacacgacccccuucgggcagcagcgcguguucaaggagaaggucgacacccggacccaggagcccaaggagggcacgaagaagcugaugaagaucaccgccgaguggcucuggaaggagcugggcaagaagaagaccccgcgcaugugcacccgggaggaguucacgcgcaaggugcgguccaacgccgcgcugggggccaucuucaccgacgagaacaaguggaaguccgcccgcgaggccguggaggacucccgguucugggagcucgucgacaaggagcgcaaccugcaccuggagggcaagugcgagaccugcguguacaacaugauggggaagcgggagaagaagcucggcgaguucgggaaggccaagggcagccgcgcgaucugguacauguggcugggcgcccgguuccuggaguucgaggcccucggguuccugaacgaggaccacugguucucccgcgagaacagccuguccggcgucgagggggagggccuccacaagcugggguacauccugcgggacgugagcaagaaggagggcggcgccauguacgcggacgacaccgccgggugggacacgcgcaucacccucgaggaccugaagaacgaggagauggugaccaaccacauggagggcgagcacaagaagcuggccgaggccaucuucaagcucaccuaccagaacaaggucgugcgggugcagcgccccacgccccgggggaccgucauggacaucaucagccgccgggaccagcgcggcuccggccaggugggcaccuacggccugaacaccuucacgaacauggaggcccagcugauccggcagauggagggggagggcguguucaagaacauccagcgccucaccgucaccgaggagguggcggugcacaacuggcuggcccgcgucgggcgggagcgccugagccggauggccaucuccggcgacgacugcguggugaagccccucgacgaccgcuucgccaacgcccugaccgcgcugaacgacaugggcaagauccggaaggacauccagcagugggagccgagcaagggguggaacgacuggacgcagguccccuucugcucccaccacuuccacgagcucaucaugaaggacggccgcauccugguggugcccugccggaaccaggacgagcugaucgggcgcgcccggaucagccagggcgccggguggucccuccgcgagaccgccugccugggcaagagcuacgcccagauguggucccugauguacuuccaccggcgcgaccuccggcuggcggccaacgccaucugcagcgccguccccucccacugggugccgaccagccgcaccacgugguccauccacgccaagcacgaguggaugaccaccgaggacaugcugaccguguggaaccgggucuggauccgcgagaaccccuggauggaggacaagacccccguggagagcugggaggagauccccuaccucggcaagcgggaggaccaguggugcgggucccugaucggccugacgagccgcgcgaccugggccaagaacauccaggccgccaucaaccaggugcggucccucaucgggaacgaggaguacaccgacuacaugccgagcaugaagcgcuuccgccgggaggaggaggaggcgggcguccugugguga

SEQ ID NO: 9622 - RNA, 9876 nt, Artificial Sequence
  derived and/or modified CDS sequence (opt1) from DENV-2__EU482542__SS-prME
agcgcggggaugaucaucaugcugauccccaccgugauggccuuccaccucaccacccggaacggggagccccacaugaucgucgggauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggccaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagguccccuucgagaucauggaccuggagaagcgcuacgugcucggccggcugaucaccgugaacccgaucgucacggagaaggacucccccgugaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcggggucuucacgagcaucggcaaggcccuccaccagguguucggggccaucuacggcgcggccuucuccggcgugagcuggaccaugaagauccugaucggggucaucaucaccuggaucggcaugaacucccggagcaccucccugagcgugucccuggugcucgucgggaucgugacgcuguaccugggcgugaugguccaggccgacagcgggugcgugguguccuggaagaacaaggagcucaagugcggcagcggcaucuucaucaccgacaacguccacaccuggaccgagcaguacaaguuccagcccgagagccccuccaagcuggccagcgcgauccagaaggcccaggaggaggggacgugcggcauccgcuccgugacccggcuggagaaccucauguggaagcagaucacccccgagcugaaccacauccuggccgagaacgaggugaagcucaccaucaugacgggggacaucaagggcaucaugcaggccgggaagcgcagccugcggccgcagcccaccgagcugaaguacuccuggaagaccuggggcaaggccaagaugcucagcaccgaguccuacaaccagacguuccugaucgacggccccgagaccgcggagugcccgaacaccaaccgcgccuggaacagccuggaggucgaggacuacggguucggcguguucaccacgaacaucuggcucaagcugaaggagaagcaggacgccuucugcgacuccaagcugaugagcgccgccaucaaggacaaccgggcggugcacgccgacaugggguacuggaucgaguccgcccucaacgacaccuggaagaucgagaaggccagcuucaucgaggucaagaacugccacuggcccaagucccacacccuguggagcaacggcgugcuggaguccgagaugaucauccccaagaaccucgccggccccgugagccagcacaacuaccgcccgggguaccacacccagaucgcgggccccuggcaccuggggaagcuggagauggacuucgacuucugcgacggcaccacggucaucgugaccgaggacugcgggaaccggggccccucccuccgcaccaccacggccagcggcaagcugaucaccgaguggugcugccggagcugcacccugcccccgcuccgcuaccgcggggaggacggcugcugguacgggauggagauccgcccccugaaggagaaggaggagaaccuggugaacucccucgucaccgccggccacggccagguggacaacuucagccugggcgugcugggcauggcccucuuccuggaggagaugcugaagacgcgggucgggaccaagcacgcgauccuccugguggccguguccuucgucacccugaucaccggcaacaugagcuucaaggaccucgggcgcgugguggucauggugggcgccacgauggccgacgacaucgggaugggcgugaccuaccuggcccugcucgcggccuucaagguccggcccaccuucgccgccggccugcugcuccgcaagcugaccuccaaggagcugaugaugacgaccaucgggaucgugcuccugagccaguccaccauccccgagaccgugcuggagcucacggacgcccuggcgcugggcaugaugguccucaagaucgugcggaacauggagaaguaccagcuggccgucaccaucauggccauccugugcgugccgaacgccgugauccuccagaacgccuggaaggucagcugcaccauccuggcggugguguccgucagcccccugcuccugaccuccagccagcagaagacggacuggaucccccuggcccucaccaucaaggggcugaaccccaccgccaucuuccugaccacgcucucccgcaccaacaagaagcgcagcuggccgcugaacgaggccaucauggcggugggcaugguguccauccuggccagcucccuccugaagaacgacauccccaugaccggcccccuggucgccgggggccuccugaccgugugcuacgugcugacggggcggagcgccgaccucgagcuggagcgcgccaccgacgucaagugggaggaccaggcggagaucuccggcagcagccccauccuguccaucaccaucagcgaggacggguccaugagcaucaagaacgaggaggaggagcagacccucacgauccugauccggaccggccugcucgugaucuccggccuguucccgaucagcauccccaucaccgccgccgccugguaccugugggaggugaagaagcagcgcgccgggguccucugggacgugcccagcccgccgcccaugggcaaggcggagcuggaggacggggccuaccggaucaagcagaagggcauccugggguacagccagaucggcgccggcguguacaaggaggggaccuuccacaccauguggcacgucacgcgcggcgccgugcucaugcacaaggggaagcggaucgagcccuccugggccgacgugaagaaggaccugaucagcuacggcgggggcuggaagcuggagggcgaguggaaggagggggaggagguccaggugcucgcgcuggagcccggcaagaacccccgcgccgugcagaccaagcccgggcuguucaagaccaacaccggcacgaucggggccgucucccucgacuucagccccggcaccuccggcagccccaucaucgacaagaaggggaagguggugggccuguacgggaacggcgucgugacccgguccggcgccuacgugagcgccaucgcgcagaccgagaaguccaucgaggacaaccccgagaucgaggacgacaucuuccgcaagcggcgccugacgaucauggaccugcaccccggggccggcaagaccaagcgguaccuccccgccaucguccgcgaggccaucaagcgggggcugcgcacccugauccucgcgccgacccgggugguggccgccgagauggaggaggcccugcgcggccugcccauccgguaccagacgcccgccauccgcgcggagcacaccgggcgggagaucgucgaccucaugugccacgccaccuucaccaugcgccugcugagccccgugcgcgugccgaacuacaaccucaucaucauggacgaggcccacuucacggaccccgccuccaucgccgcgcggggcuacaucagcacccgcgucgagaugggcgaggccgccgggaucuucaugaccgccacgccgcccggcagccgggacccguucccccaguccaacgcccccaucaucgacgaggagcgcgagauccccgagcggagcuggaacuccgggcacgagugggugacggacuucaagggcaagaccgugugguucgucccgagcaucaaggcggggaacgacaucgccgccugccugcgcaagaacggcaagaaggugauccagcugucccggaagaccuucgacagcgaguacgugaagacccgcacgaacgacugggacuucgucgugaccaccgacaucuccgagaugggcgccaacuucaaggcggagcgggugaucgacccccgccggugcaugaagcccgucauccucaccgacggggaggagcgcgugauccuggccggccccaugccggugacgcacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacccccgagggcaucaucccgagcauguucgagcccgagcgggagaaggucgacgccaucgacggcgaguaccgccugcgcggggaggcccgcaagaccuucguggaccucaugcgccggggcgaccugcccguguggcuggccuacaaggucgccgcggaggggaucaacuacgccgaccgccgguggugcuucgacggcaucaagaacaaccagauccucgaggagaacguggaggucgagaucuggaccaaggagggggagcgcaagaagcugaagccgcgguggcuggacgcccgcaucuacuccgacccccucgcccugaaggaguucaaggaguucgccgcgggccggaagucccugacgcucaaccugaucaccgagaugggccgccugcccaccuucaugacccagaagacgcgggacgcccucgacaaccuggccgugcugcacaccgccgaggccggcgggcgcgccuacaaccacgcccucuccgagcugcccgagacccuggagacccuccugcugcucacgcugcuggccaccgugaccgggggcaucuuccucuuccugaugagcggcaaggggaucggcaagaugacccuggggaugugcugcaucaucaccgccuccauccuccugugguacgcgcagauccagccgcacuggaucgccgccagcaucauccuggaguucuuccucaucguccugcugauccccgagcccgagaagcagcggacgccccaggacaaccagcucaccuacguggugaucgccauccugaccgucguggccgcgaccauggccaacgagaugggcuuccuggagaagacgaagaaggaccucgggcugggcuccaucgccacccagcagccggagagcaacauccuggacaucgaccuccgccccgccuccgccuggacccuguacgcgguggccaccacguucgucacccccaugcugcggcacagcaucgagaacagcuccgugaacgugagccucaccgccaucgccaaccaggccaccguccugaugggccuggggaagggcuggccccucuccaagauggacaucggggugccgcugcuggcgaucggcugcuacagccaggugaaccccaucacgcucaccgccgcccugcugcuccuggucgcccacuacgcgaucaucgggcccggccugcaggccaaggccacccgcgaggcccagaagcgggccgcggccggcaucaugaagaaccccaccguggacgggaucacggugaucgaccucgacccgauccccuacgaccccaaguucgagaagcagcugggccaggucaugcugcucauccugugcgugacccaggugcugaugaugcgcaccaccugggcccucugcgaggcccugacgcuggccaccgggcccaucuccacccucugggagggcaacccggggcgguucuggaacaccacgaucgcggucagcauggccaacaucuuccgcggcuccuaccuggccggcgccgggcuccucuucagcaucaugaagaacaccaccaacacccggcgcggcacggggaacaugggcgagacccugggcgagaaguggaagucccggcugaacgcccucggcaagagcgaguuccagaucuacaagaaguccggcauccaggagguggaccgcacccuggcgaaggaggggaucaagcgcggcgagaccgaccaccacgccgugagccggggguccgccaagcugcgcugguucgucgagcggaacauggugacgcccgagggcaagguggucgaccucggcugcgggcgcggcggguggagcuacuacugcggcgggcugaagaacgugcgggaggugaagggccugaccaagggcgggcccggccacgaggagcccaucccgauguccaccuacggguggaaccucguccgccugcagagcggcguggacguguucuucaucccgcccgagaagugcgacacccugcucugcgacaucggggaguccagccccaacccgacggucgaggccggccggacccugcgcgugcugaaccucguggagaacuggcugaacaacaacacccaguucugcaucaagguccugaaccccuacaugcccuccgugaucgagaagauggaggcgcugcagcggaaguacggcggggcccucgugcgcaacccgcugagccggaacagcacccacgagauguacugggucuccaacgccagcggcaacaucguguccagcgugaacaugaucucccgcaugcugaucaaccgguucaccaugcgccacaagaaggccacguacgagcccgacgucgaccucgggagcggcacccggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgcguccagcauggugaacggcgugguccggcugcucaccaagccgugggacgugcugcccaccgugacgcagauggccaugaccgacaccacccccuucgggcagcagcgcgucuucaaggagaagguggacacgcggacccaggagcccaaggagggcaccaagaagcugaugaagaucaccgccgaguggcucuggaaggagcugggcaagaagaagacgccgcgcaugugcacccgcgaggaguucacccggaaggugcgcuccaacgccgcccugggggcgaucuucaccgacgagaacaaguggaaguccgcccgggaggccgucgaggacucccgcuucugggagcucguggacaaggagcggaaccugcaccuggagggcaagugcgagacgugcgucuacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcguggagggggagggccuccacaagcugggguacauccugcgcgacgugagcaagaaggagggcggcgccauguacgccgacgacaccgcggggugggacacccggaucacccucgaggaccugaagaacgaggagauggucacgaaccacauggagggcgagcacaagaagcuggccgaggccaucuucaagcucaccuaccagaacaagguggugcgcguccagcggcccacgccccgggggaccgugauggacaucaucagccggcgcgaccagcggggcuccggccagguggggacguacggccugaacaccuucaccaacauggaggcccagcugauccgccagauggagggggagggcgucuucaagaacauccagcaccucaccgugacggaggagguggccguccagaacuggcuggcgcggguggggcgcgagcggcugagccgcauggccaucuccggcgacgacugcguggucaagccccucgacgaccgcuucgccaacgcccugaccgcccugaacgacaugggcaagauccggaaggacauccagcagugggagccgagcaagggguggaacgacuggacccaggugcccuucugcucccaccacuuccacgagcucaucaugaaggacggccgcauccuggugguccccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccgugcccucccacugggugccgacgagccgcaccaccugguccauccacgccaagcacgaguggaugaccaccgaggacaugcugacggucuggaaccggguguggauccgcgagaaccccuggauggaggacaagacccccguggagagcugggaggagauccccuaccucggcaagcgggaggaccaguggugcgggucccugaucggccugaccagccgcgccaccugggcgaagaacauccaggccgccaucaaccagguccggucccucaucgggaacgaggaguacacggacuacaugccgagcaugaagcgcuuccggcgcgaggaggaggaggccggcgugcugugguga

SEQ ID NO: 9623 - RNA, 9876 nt, Artificial Sequence
  derived and/or modified CDS sequence (opt1) from DENV-2__JX966380__SS-prME
accgcgggcaugaucaucaugcugauccccaccgugauggccuuccaccucaccacccgcaacggggagccccacaugaucgucagccggcaggagaagggcaagagccugcuguucaagaccaaggacgggaccaacaugugcacccucauggcgauggaccugggcgagcugugcgaggacaccaucaccuacaagugccccuuccucaagcagaacgagcccgaggacaucgacugcuggugcaacagcaccuccaccugggugaccuacgggaccugcaccacgaccggcgagcaccgccgggagaagcgcagcguggcccuggucccccacgugggcauggggcuggagacccggaccgagacguggauguccagcgagggcgccuggaagcacgcccagcgcaucgagaccuggauccuccggcaccccggguucaccaucauggccgcgauccuggccuacaccaucggcacgacccacuuccagcgcgugcugaucuucauccuccugaccgccaucgcccccuccaugaccaugcggugcaucgggaucagcaaccgcgacuucgucgagggcguguccggcgggagcuggguggacaucguccuggagcacggcuccugcgugacgaccauggcgaagaacaagcccacccucgacuucgagcugaucaagaccgaggccaagcagcccgccacgcugcggaaguacugcaucgaggccaagcucaccaacaccaccacggacagccgcugcccgacccagggggagcccacccugaacgaggagcaggacaagcgguucgugugcaagcacuccauggucgaccgcggcuggggcaacgggugcggccuguucgggaagggcgggaucgugaccugcgccauguucacgugcaagaagaacauggagggcaagaucgugcagcccgagaaccucgaguacaccgucgugaucacgccccacagcggcgaggagcacgcgguggggaacgacaccggcaagcacgggaaggaggucaagaucaccccgcaguccagcaucacggaggccgagcugaccggcuacgggaccgugaccauggagugcagcccccggacgggccuggacuucaacgagauggugcuccugcagaugaaggacaaggccuggcugguccaccgccagugguuccucgaccugccccugcccuggcucccgggcgccgacacccaggggagcaacuggauccagaaggagacccuggugaccuucaagaacccccacgccaagaagcaggacguggucgugcugggcucccaggagggggcgaugcacacggcccucaccggcgccaccgagauccagaugagcagcgggaaccugcuguucaccggccaccucaagugccggcugcgcauggacaagcugcagcucaagggcauguccuacagcaugugcacggggaaguucaagaucgucaaggagaucgccgagacccagcacggcaccaucgugauccgggugcaguacgagggggacggcucccccugcaagauccccuucgagaucauggaccuggagaagcgccacguccugggccggcucaucaccgugaacccgaucgugacggagaaggacagccccgucaacaucgaggccgagccgcccuucggggacuccuacaucaucaucggcguggagccggggcagcugaagcuggacugguucaagaagggcagcuccaucgggcagauguucgagaccaccaugcgcggcgcgaagcgcauggccauccucggcgacaccgccugggacuucgggagccugggcgggguguucacguccaucggcaaggcccugcaccaggucuucggggccaucuacggcgcggccuucagcggcguguccuggaccaugaagauccucaucggggugaucaucaccuggaucggcaugaacagccgguccaccagccuguccgucagccuggugcugguggggaucgucacgcucuaccugggcgugauggugcaggccgacuccgggugcgucgugagcuggaagaacaaggagcugaagugcggcuccggcaucuucgugaccgacaacguccacaccuggaccgagcaguacaaguuccagcccgagagccccagcaagcucgccuccgcgauccagaaggcccacgaggaggggaucugcggcauccgcagcgugacgcggcuggagaaccugauguggaagcagaucaccuccgagcucaaccacauccugagcgagaacgaggugaagcugaccaucaugaccggggacaucaagggcaucaugcaggucgggaagcgcucccuccggccccagccgacggagcugcgcuacagcuggaagaccuggggcaaggccaagacccuguccaccgagcuccacaaccagacguuccugaucgacggccccgagaccgccgagugccccaacaccaaccgggccuggaacagccuggagguggaggacuacggguucggcguguucaccaccaacaucuggcuccgccugcgggagaagcaggacgucuucugcgacuccaagcugaugagcgcggccaucaaggacaaccgcgccgugcacgccgacaugggguacuggaucgaguccgcccucaacgacacguggaagaucgagaaggcgagcuucaucgaggugaaguccugccacuggcccaagucccacacccugugguccaacggcguccuggagagcgagauggugauccccaagaacuucgccggccccgugucccagcacaacaaccggcccggguaccacacccagaccgccggcccguggcaccucgggaagcuggagauggacuucgacuucugcgagggcacgaccgucguggugaccgaggacugcgggaaccgcggccccagccugcggaccacgaccgccagcggcaagcucaucaccgaguggugcugccgcuccugcacccugccgccccugcgguaccgcggggaggacggcugcugguacgggauggagauccggccgcucaaggagaaggaggagaaccuggucagcucccuggugacggccggccacgggcagaucgacaacuucagccucggcauccugggcauggcgcuguuccucgaggagaugcugcgcacccggguggggaccaagcacgccauccugcucgucgccguguccuucgugacccugaucacgggcaacaugagcuuccgcgaccuggggcgcgucauggugauggugggcgccaccaugaccgacgacaucgggaugggcgucaccuaccucgcgcugcuggccgccuucaaggugcggcccacguucaccgccggccuccugcugcgcaagcucaccuccaaggagcugaugaugaccacgaucgggaucgugcugcucagccaguccagcauccccgagaccauccuggagcugaccgacgcccucgcgcugggcaugaugguccugaagauggugcggaacauggagaaguaccagcucgccgugaccaucauggccauccugugcguccccaacgccgugauccugcagaacgccuggaaggucuccugcacgauccucgcgguggugagcgucuccccgcugcugcucaccagcucccagcagaaggccgacuggaucccccuggcccugaccaucaaggggcucaaccccaccgccaucuuccugacgacccugagccgcaccuccaagaagcggagcuggccccucaacgaggccaucauggcggugggcaugguguccauccuggccagcagccugcucaagaacgacaucccgaugaccggcccccuggucgccgggggccugcucacggugugcuacgugcugaccgggcgcuccgccgaccuggagcucgagcgggcgaccgacgucaagugggacgaccaggccgagaucagcggcuccagccccauccuguccaucaccaucagcgaggacggguccaugagcaucaagaacgaggaggaggagcagacccugacgauccucauccgcaccggccugcuggugaucuccggccucuuccccgugagcaucccgaucaccgccgccgccugguaccugugggaggucaagaagcagcgggcgggggugcugugggacgugcccagcccgccgcccgucggcaaggccgagcucgaggacggggccuaccgcaucaagcagaagggcauccugggguacagccagaucggcgccggcguguacaaggaggggaccuuccacacgauguggcacgugacccggggcgccguccugaugcacaaggggaagcgcaucgagcccuccugggcggacgugaagaaggaccucaucagcuacggcgggggcuggaagcuggagggcgaguggaaggagggggaggaggugcagguccuggcccucgagcccggcaagaacccccgggccgugcagaccaagcccgggcuguuccgcaccaacacgggcaccaucggggccgugucccuggacuucagccccggcaccuccggcagccccaucgucgacaagaaggggaagguggugggccucuacgggaacggcgucgugacccgguccggcgccuacgugagcgcgaucgcccagacggagaaguccaucgaggacaacccggagaucgaggacgacaucuuccgcaagcggcgccugaccaucauggaccugcaccccggggccggcaagaccaagcgguaccugcccgccaucguccgcgaggccaucaagcgggggcuccgcacccugauccuggcgcccacgcgcgugguggccgccgagauggaggaggcccuccggggccugccgauccgcuaccagacccccgcgauccgggccgagcacaccgggcgcgagaucgucgaccugaugugccacgccaccuucacgaugcggcuccugagccccauccgcgugcccaacuacaaccugaucaucauggacgaggcccacuucaccgacccggccagcaucgcggcccggggcuacaucuccacccgcguggagaugggcgaggccgccgggaucuucaugaccgccacgccgcccggcagccgggaccccuucccgcaguccaacgcgcccaucauggacgaggagcgcgagauccccgagcggagcuggaacuccgggcacgagugggucaccgacuucaagggcaagaccgugugguucgugcccagcaucaagaccgggaacgacaucgccgccugccuccgcaagaacggcaagcgggucauccagcugucccgcaagacguucgacagcgaguacgugaagacccggaccaacgacugggacuucguggucaccacggacaucuccgagaugggcgccaacuucaaggccgagcgcgugaucgacccgcggcgcugcaugaagcccgugauccugaccgacggggaggagcgggucauccucgcgggccccaugcccgugacccacagcuccgccgcccagcgccgcgggcggaucggccgcaacccgcggaacgagaacgaccaguacaucuacaugggggagccccuggagaacgacgaggacugcgcccacuggaaggaggcgaagaugcugcucgacaacaucaacacccccgagggcaucauccccagcauguucgagccggagcgcgagaagguggacgccaucgacggcgaguaccggcugcgcggggaggcccggaagacguucgucgaccugaugcgccggggcgaccuccccguguggcuggccuacaagguggccgcggaggggaucaacuacgccgaccgccgguggugcuucgacggcacccgcaacaaccagauccuggaggagaacgucgagguggagaucuggaccaaggagggggagcggaagaagcucaagccccgcuggcuggacgcccggaucuacuccgacccgcuggcccucaaggaguucaaggaguucgccgcgggccgcaagagccugacccugaaccucaucacggagaugggccggcugcccaccuucaugacccagaaggcccgcgacgcccuggacaaccucgccguccugcacaccgccgaggccgggggcaaggccuacaaccacgcccuguccgagcuccccgagacccuggagacgcugcuccugcugacccuccuggccaccgugaccgggggcaucuuccuguuccucaugagcggccgggggaucggcaagaugacgcuggggaugugcugcaucaucaccgcguccauccugcucugguacgcccagauccagccccacuggaucgccgccagcaucauccuggaguucuuccugaucgugcuccugaucccggagcccgagaagcagcgcacgccccaggacaaccagcugaccuacgucaucaucgccauccucacggugguggcggccaccauggccaacgagaugggcuuccuggagaagaccaagaaggaccuggggcucggcaacaucgccacccagcagcccgagagcaacauccuggacaucgaccugcggccggccuccgcguggacgcucuacgccgucgccaccaccuucaucacccccaugcugcgccacagcaucgagaacuccagcgugaacgugucccugacggccaucgccaaccaggcgaccguccucaugggccuggggaagggcuggccccugagcaagauggacaucggggugccccuccuggccaucggcugcuacucccaggugaacccgaucacccugaccgccgcccuccugcugcucgucgcccacuacgcgaucaucgggcccggccugcaggccaaggccacgcgcgaggcccagaagcgggcggccgccggcaucaugaagaaccccaccguggacgggaucaccgugaucgaccuggaccccaucccguacgaccccaaguucgagaagcagcucggccaggucaugcugcuggugcucugcgugacccagguccugaugaugcgcacgaccugggcccugugcgaggcccucacccuggcgaccgggcccgugagcacgcugugggagggcaaccccgggcgguucuggaacaccaccaucgccguguccauggccaacaucuuccgcggcagcuaccucgccggcgccgggcugcuguucuccaucaugaagaacaccacgagcacccggcgcggcaccgggaacaucggcgagacccucggcgagaaguggaagucccggcugaacgcgcuggggaaguccgaguuccagaucuacaagaaguccggcauccaggaggucgaccgcacgcucgccaaggaggggaucaagcggggcgagaccgaccaccacgccgugagccgcggguccgccaagcugcggugguucguggagcgcaaccuggucaccccggagggcaaggugguggaccucggcugcgggcggggcggguggagcuacuacugcggcgggcugaagaacguccgcgaggugaagggccugaccaagggcgggcccggccacgaggagcccauccccauguccaccuacggguggaaccucgugcggcugcagagcggcgucgacguguucuucgugccgcccgagaagugcgacacgcugcucugcgacaucggggagagcucccccaaccccaccgucgaggccggccgcacccugcgggugcugaaccucguggagaacuggcugaacaacaacacccaguucugcgucaaggugcugaacccguacaugcccagcgugaucgagcgcauggagacgcugcagcggaaguacggcggggcgcucguccgcaacccccugucccgcaacagcacccacgagauguacuggguguccaacgccagcggcaacaucguguccagcgucaacaugaucucccggaugcugaucaaccgcuucaccaugcggcacaagaaggccaccuacgagccggacguggaccucgggagcggcacgcgcaacaucgggaucgaguccgagacccccaaccuggacaucaucggcaagcggaucgagaagaucaagcaggagcacgagaccagcuggcacuacgaccaggaccaccccuacaagaccugggccuaccacggcuccuacgagacgaagcagaccgggagcgcguccagcauggugaacggcgucgugcgccugcucaccaagcccugggacguggucccgauggugacccagauggccaugacggacaccacccccuucgggcagcagcggguguucaaggagaaggucgacacccgcacgcaggagcccaaggagggcaccaagaagcugaugaagaucaccgccgaguggcuguggaaggagcucggcaagaagaagacgccccggaugugcacgcgcgaggaguucaccaagaaggugcgguccaacgccgcccugggggcgaucuucaccgacgagaacaaguggaaguccgcccgcgaggccgucgaggacucccgguucugggagcugguggacaaggagcgcaaccuccaccuggagggcaagugcgagaccugcguguacaacaugauggggaagcgggagaagaagcugggcgaguucgggaaggccaagggcagccgcgccaucugguacauguggcucggcgcgcgguuccuggaguucgaggcccugggguuccucaacgaggaccacugguucagccgcgagaacucccugagcggcgucgagggggagggccugcacaagcucggguacauccugcgggagguguccaagaaggagggcggcgccauguacgccgacgacacggccgggugggacacccgcaucaccaucgaggaccugaagaacgaggagaugaucaccaaccacauggcgggcgagcacaagaagcucgccgaggccaucuucaagcugacguaccagaacaaggugguccgggugcagcgcccgacgccccgcgggaccgugauggacaucaucagccggcgcgaccagcggggcuccgggcaggucggcaccuacggccugaacaccuucaccaacauggaggcccagcucauccgccagauggagggggagggcaucuucaagaacauccagcaccugaccgcgagcgaggagaucgccgugcaggacuggcuggugcgggucgggcgcgagcggcucucccgcauggccaucagcggcgacgacugcguggugaagccccuggacgaccgguucgcccgcgcccugaccgcgcucaacgacaugggcaagguccggaaggacauccagcagugggagcccucccgcggguggaacgacuggacccaggugccguucugcagccaccacuuccacgagcugaucaugaaggacggccggacgcuggugguccccugccgcaaccaggacgagcucaucgggcgggcccgcaucucccagggcgccggguggagccugcgggagaccgccugccugggcaaguccuacgcccagauguggagccucauguacuuccaccgccgggaccugcgccuggcggccaacgccaucugcuccgccgugcccagccacugggugcccaccucccgcaccacguggagcauccacgccagccacgaguggaugaccaccgaggacaugcucaccgucuggaacaagguguggauccuggagaacccguggauggaggacaagacgcccguggaguccugggaggagauccccuaccugggcaagcgggaggaccaguggugcgggagccucaucggccugaccucccgcgcgaccugggccaagaacauccagaccgccaucaaccagguccggagccugaucgggaacgaggaguacacggacuacaugcccuccaugaagcgcuuccggcgcgaggaggaggaggccggcgugcucugguga

SEQ ID NO: 9624 - RNA, 9876 nt, Artificial Sequence
  derived and/or modified CDS sequence (opt1) from DENV-2__JX966379__SS-prME
accgccggcaugaucaucaugcugauccccaccgugauggccuuccaccucaccacccggaacggggagccccacaugaucgucagccggcaggagaagggcaagagccugcuguucaagaccaaggacgggaccaacaugugcacccucauggcgauggaccugggcgagcugugcgaggacaccaucaccuacaagugccccuuccucaagcagaacgagcccgaggacaucgacugcuggugcaacagcaccuccaccugggugaccuacgggaccugcaccaccaccggcgagcaccggcggggcaagcggagcguggcccuggucccccacguggggaugggccuggagacccggaccgagacguggauguccagcgagggggccuggaagcacgcccagcgcaucgagaccuggauccuccggcaccccggcuucaccaucauggccgcgauccuggccuacaccaucgggacgacccacuuccagcgggugcugaucuucauccuccugaccgccaucgcccccuccaugaccaugcggugcaucggcaucagcaaccgcgacuucgucgagggcguguccgggggcagcuggguggacaucguccuggagcacggguccugcgugacgaccauggcgaagaacaagcccacccucgacuucgagcugaucaagaccgaggccaagcagcccgccagccugcggaaguacugcaucgaggccaagcucacgaacaccaccaccgacucccgcugcccgacgcagggcgagcccacccugaacgaggagcaggacaagcgguucgugugcaagcacagcauggucgaccgcggcugggggaacggcugcgggcuguucggcaagggcgggaucgugaccugcgccauguucacgugcaagaagaacauggagggcaagaucgugcagcccgagaaccucgaguacacggucgugaucacgccccacuccggggaggagcacgcggugggcaacgacaccgggaagcacggcaaggaggucaagaucaccccgcagagcuccaucaccgaggccgagcugacgggguacggcaccgugaccauggagugcagcccccggaccggccuggacuucaacgagauggugcuccugcagauggaggacaaggccuggcugguccaccgccagugguuccucgaccugccccugcccuggcucccgggggccgacacgcagggcuccaacuggauccagaaggagacccuggugaccuucaagaacccccacgccaagaagcaggacguggucgugcuggggagccaggagggcgcgaugcacaccgcccucacgggggccaccgagauccagaugagcuccggcaaccugcuguucaccggccaccucaagugccggcugcgcauggacaagcugcagcucaaggggaugagcuacuccaugugcaccggcaaguucaagaucgucaaggagaucgccgagacgcagcacgggaccaucgugauccgggugcaguacgagggcgacggcagccccugcaagauccccuucgagaucauggaccuggagaagcgccacguccuggggcggcucaucaccgugaacccgaucgugaccgagaaggacucccccgucaacaucgaggccgagccgcccuucggcgacagcuacaucaucaucgggguggagccgggccagcugaagcuggacugguucaagaagggguccagcaucggccagauguucgagacgaccaugcgcggcgcgaagcgcauggccauccucggggacaccgccugggacuucggcucccucggcgggguguucaccagcaucgggaaggcccugcaccaggucuucggggccaucuacggcgcggccuucuccggggugagcuggacgaugaagauccucaucggcgugaucaucaccuggaucgggaugaacucccggagcaccucccugagcgucucccuggugcuggugggcaucgucacccucuaccugggggugauggugcaggccgacagcggcugcgucguguccuggaagaacaaggagcugaagugcggcagcgggaucuucgugacggacaacguccacaccuggaccgagcaguacaaguuccagcccgagagccccuccaagcucgccagcgcgauccagaaggcccacgaggagggcaucugcgggauccgcuccgugacccggcuggagaaccugauguggaagcagaucacgcccgagcucaaccacauccugagcgagaacgaggugaagcugaccaucaugaccggcgacaucaaggggaucaugcaggucggcaagcgcucccuccggccgcagcccaccgagcugcgcuacagcuggaagacguggggcaaggccaagaugcuguccaccgagcuccacaaccagaccuuccugaucgacgggcccgagaccgccgagugcccgaacacgaaccgggccuggaacagccuggagguggaggacuacggcuucgggguguucaccaccaacaucuggcuccgccugcgggagaagcaggacgucuucugcgacuccaagcugaugagcgcggccaucaaggacaaccgcgccgugcacgccgacaugggcuacuggaucgaguccgcccucaacgacaccuggaagaucgagaaggcgagcuucaucgaggugaaguccugccacuggcccaagagccacacccugugguccaacggcguccuggagagcgagauggugauccccaagaacuacgccgggcccgugucccagcacaacaaccggccgggcuaccacacgcagaccgccgggcccuggcaccucggcaagcuggagauggacuucgacuucugcgaggggaccaccgucguggugacggaggagugcggcaaccgcggccccagccugcggaccaccaccgccagcgggaagcucaucacggaguggugcugccgcuccugcacccugcccccgcugcgguaccgcggcgaggacgggugcugguacggcauggagauccggccccucaaggagaaggaggagaaccuggucagcucccuggugaccgccgggcacggccagaucgacaacuucagccucggcauccuggggauggcgcuguuccucgaggagaugcugcgcucccgggugggcaccaagcacgccauccugcucgucgccgugagcuucgugacgcugaucaccgggaacauguccuuccgcgaccugggccgcgucauggugauggugggggccaccaugaccgacgacaucggcaugggcgucacguaccucgcgcugcuggccgccuacaaggugcggcccaccuucgccgccgggcuccugcugcgcaagcucaccagcaaggagcugaugaugaccacgaucggcaucgugcugcucucccagagcuccauccccgagaccauccuggagcugaccgacgcgcucgcccuggggaugaugguccugaagauggugcggaacauggagaaguaccagcucgccgugaccaucauggccauccugugcgucccgaacgccgugauccugcagaacgcguggaaggucagcugcacgacccucgccgugguguccgucagcccccugcugcucaccuccagccagcagaaggccgacuggaucccccuggcccugaccaucaagggccucaaccccacggccaucuuccugaccacccugucccgcaccagcaagaagcgguccuggccgcucaacgaggcgaucauggccgugggcauggugagcauccuggccagcucccugcucaagaacgacauccccaugacggggccccuggucgccggcgggcugcucaccgugugcuacgugcugaccggccgcagcgcggaccuggagcucgagcgggccaccgacgucaagugggacgaccaggccgagaucuccgggagcucccccauccugagcaucacgaucuccgaggacggcagcauguccaucaagaacgaggaggaggagcagacccugaccauccucauccgcaccggccugcuggugaucagcgggcuguucccgguguccacccccaucacggccgccgcgugguaccugugggaggucaagaagcagcgggccggcgugcugugggacgugcccagcccgccgcccgucgggaaggccgagcucgaggacggcgccuaccgcaucaagcagaaggggauccugggcuacucccagaucggcgccgggguguacaaggagggcaccuuccacaccauguggcacgugacccgcggggccguccugaugcacaagggcaagcgcaucgagcccagcugggccgacgugaagaaggaccucaucuccuacgggggcggcuggaagcuggagggggaguggaaggagggcgaggaggugcagguccuggcccucgagcccgggaagaacccccgggccgugcagacgaagcccggccuguuccgcaccaacaccgggaccaucggcgccgugagccuggacuucucccccggcacgagcgggucccccaucgucgacaagaagggcaaggugguggggcucuacggcaacggcgucgugacccggagcggggcguacgugagcgccaucgcccagaccgagaaguccaucgaggacaaccccgagaucgaggacgacaucuuccgcaagcggcgccugaccaucauggaccugcaccccggcgccgggaagacgaagcgguaccugcccgccaucguccgcgaggcgaucaagcggggccuccgcacccugauccuggccccgacccgcgugguggccgccgagauggaggaggcgcuccgggggcugcccauccgcuaccagacccccgccauccgggccgagcacacgggccgcgagaucgucgaccugaugugccacgccaccuucaccaugcggcuccugagccccauccgcgugccgaacuacaaccugaucaucauggacgaggcccacuucaccgaccccgcguccaucgccgcccggggcuacaucagcacgcgcguggagaugggggaggccgccggcaucuucaugaccgcgacgccgcccgggucccgggacccguucccccagagcaacgcccccaucauggacgaggagcgcgagauccccgagcgguccuggaacagcggccacgagugggucaccgacuucaaggggaagacggugugguucgugccguccaucaaggccggcaacgacaucgcgaccugccuccgcaagaacggcaagcgggucauccagcugagccgcaagaccuucgacuccgaguacgugaagacccggacgaacgacugggacuucguggucaccaccgacaucagcgagaugggggccaacuucaaggcggagcgcgugaucgacccccggcgcugcaugaagcccgugauccugaccgacggcgaggagcgggucauccucgccgggcccaugccggugacgcacuccagcgccgcccagcgccgcggccggaucgggcgcaacccccggaacgagaacgaccaguacaucuacaugggcgagccccuggagaacgacgaggacugcgcgcacuggaaggaggccaagaugcugcucgacaacaucaacacccccgagggcaucaucccguccauguucgagcccgagcgcgagaagguggacgccaucgacggggaguaccggcugcgcggcgaggcccggaagaccuucgucgaccugaugcgccgcggggaccuccccguguggcuggccuacaagguggcgagcgagggcaucaacuacgccgaccgccgguggugcuucgacgggacccgcaacaaccagauccuggaggagaacgucgagguggagaucuggacgaaggagggcgagcggaagaagcucaagccgcgcuggcuggacgcccggaucuacuccgacccccuggcccucaaggaguucaaggaguucgccgcgggccgcaagagccugacccugaaccucaucaccgagauggggcggcugcccaccuucaugacgcagaaggcccgcgacgcccuggacaaccucgccguccugcacaccgccgaggcgggcgggaaggccuacaaccacgcccuguccgagcuccccgagacccuggagacccugcuccugcugacccuccuggccacggugaccggcggcaucuuccuguuccucaugagcgggcggggcaucgggaagaugacccugggcaugugcugcaucaucaccgcgagcauccugcucugguacgcccagauccagccgcacuggaucgccgccuccaucauccuggaguucuuccugaucgugcuccugauccccgagcccgagaagcagcgcacgccccaggacaaccagcugaccuacgucaucaucgccauccucaccgugguggcggccaccauggccaacgagaugggguuccuggagaagacgaagaaggaccugggccucggccacaucgccacccagcagccggagagcaacauccuggacaucgaccugcggcccgccuccgcguggacccucuacgccgucgccaccacguucaucacccccaugcugcgccacagcaucgagaacuccagcgugaacgugucccugaccgccaucgccaaccaggcgaccguccucauggggcugggcaagggguggccccugagcaagauggacaucggcgugccgcuccuggccaucgggugcuacucccaggugaaccccaucacgcugaccgccgcccuccugcugcucgucgcccacuacgcgaucaucggccccggccugcaggccaaggccacccgcgaggcccagaagcgggcggccgccgggaucaugaagaaccccaccguggacggcaucacggugaucgaccuggacccgauccccuacgaccccaaguucgagaagcagcucgggcaggucaugcugcuggugcucugcgugacccagguccugaugaugcgcaccaccugggcccugugcgaggcccucacgcuggcgaccggccccgugagcacccugugggaggggaacccgggccgguucuggaacaccacgaucgccguguccauggccaacaucuuccgcggcagcuaccucgccggggccggccugcuguucuccaucaugaagaacaccaccagcacccggcgcgggacgggcaacaucggcgagacccucggggagaaguggaagucccggcugaacgcgcugggcaagagcgaguuccagaucuacaagaaguccgggauccaggaggucgaccgcacccucgccaaggagggcaucaagcgcggggagaccgaccaccacgccgugagccgcggcuccgccaagcugcggugguucguggagcgcaaccuggucacgcccgagggcaaggugguggaccucgggugcggccgcgggggcuggagcuacuacugcgggggccugaagaacguccgcgaggugaagggccugaccaagggcggccccgggcacgaggagcccaucccgaugagcaccuacggcuggaaccucgugcggcugcaguccggggucgacguguucuucgugccgcccgagaagugcgacacccugcucugcgacaucggcgagagcucccccaacccgaccgucgaggccggccgcacgcugcgggugcugaaccucguggagaacuggcugaacgacaacacccaguucugcgucaaggugcugaaccccuacaugcccagcgugaucgagcgcauggagacccugcagcggaaguacgggggcgcgcucguccgcaacccgcugucccgcaacagcacccacgagauguacuggguguccaacgccagcgggaacguggucuccagcgugaacaugaucucccggaugcugaucaaccgcuucacgaugcggcacaagaaggccaccuacgagcccgacguggaccucggcagcgggacccgcaacaucggcaucgaguccgagacccccaaccuggacaucaucggcaagcggaucgagaagaucaagcaggagcacgaggccagcuggcacuacgaccaggaccaccccuacaagacgugggcguaccacggguccuacgagaccaagcagaccggcagcgccuccagcauggucaacgggguggugcgccugcucaccaagccgugggacgucgugcccauggugacgcagauggccaugaccgacaccacccccuucggccagcagcgggucuucaaggagaagguggacacgcgcacccaggagcccaaggagggcaccaagaagcugaugaagaucaccgccgaguggcuguggaaggagcucgggaagaagaagacgccgcggaugugcacccgcgaggaguucaccaagaagguccgguccaacgccgcgcugggcgccaucuucaccgacgagaacaaguggaaguccgcccgcgaggccguggaggacaaccgguucugggagcugguggacaaggagcgcaaccuccaccuggaggggaagugcgagacgugcgucuacaacaugaugggcaagcgggagaagaagcugggggaguucggcaaggcccgcggcagccgggcgaucugguacauguggcucggggcccgcuuccuggaguucgaggcccugggcuuccucaacgaggaccacugguucucccgggagaacagccuguccgggguggagggcgaggggcugcacaagcucggcuacauccugcgcgaggugagcaagaaggagggcggggccauguacgccgacgacaccgcgggcugggacacccggaucaccaucgaggaccugaagaacgaggagaugaucacgaaccacauggccggggagcacaagaagcucgccgaggccaucuucaagcugaccuaccagaacaaggucgugcgcgugcagcgccccacgccccggggcaccgucauggacaucaucucccgccgggaccagcgcgggagcggccagguggugacguacggccugaacaccuucaccaacauggaggcgcagcucauccggcagauggagggggagggcaucuucaaguccauccagcaccugaccgccagcgaggagaucgccguccaggacuggcuggcccgcguggggcgggagcgccucucccggauggccaucagcggcgacgacugcguggucaagccccuggacgaccgcuucgcgcgggcccugacggcccucaacgacaugggcaaggugcgcaaggacauccagcagugggagccgucccggggguggaacgacuggacccaggugcccuucugcagccaccacuuccacgagcugaucaugaaggacggccgcacccuggucgugcccugccggaaccaggacgagcucaucgggcgcgcccggaucucccagggcgccggguggagccugcgcgagaccgcgugccugggcaaguccuacgcccagauguggagccucauguacuuccaccggcgcgaccugcgccuggccgccaacgccaucugcuccgcggugcccagccacugggucccgaccagccggacgaccugguccauccacgccagccacgaguggaugaccaccgaggacaugcucacgguguggaaccgcguguggauccuggagaaccccuggauggaggacaagacccccgucgaguccugggaggagauccccuaccugggcaagcgggaggaccaguggugcgggagccucaucggccugaccucccgcgccaccugggccaagaacauccagacggccaucaaccaggugcggagccugaucgggaacgaggaguacaccgacuacaugccguccaugaagcgcuuccggcgcgaggaggaggaggcgggcgugcucugguga

SEQ ID NO: 9625 - RNA, 9876 nt, Artificial Sequence
  derived and/or modified CDS sequence (opt1) from DENV-2__KP012546__SS-prME
accgccggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaagaccuggggcaaggcgaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuucugcgacagcaagcugauguccgccgccaucaaggacaaccgggcggugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgcgggccccuggcaccucgggcggcuggagauggacuucgacuucugcgagggcacgaccguggucgugaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggucacggccggccacgggcagaucgacaacuucagccucggcgugcugggcauggcccuguuccucgaggagaugcugcgcacccggguggggaccaagcacgcgauccugcucgucgccguguccuucgugacccugaucacgggcaacaugagcuuccgcgaccuggggcgcgucauggugauggugggcgccgccaugaccgacgacaucgggaugggcgucaccuaccucgcccugcuggcggccuucaaggugcggcccaccuucgccgccggccuccugcugcgcaagcucacguccaaggagcugaugaugaccaccaucgggaucgugcugcucagccaguccaccaugcccgagacgauccuggagcugaccgacgcccucgcgcugggcaugaugguccugaagaucgugcggaacauggagaaguaccagcucgccgucaccaucauggccauccugugcgugccgaacgccgugauccugcagaacgccuggaaggucagcugcaccacgcucgcggugguguccgucagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgugggcauggugagcauccuggccuccagccugcucaagaacgacauccccaugaccggcccccuggucgccgggggccugcucacggugugcuacgugcugaccgggcgcagcgccgaccuggagcucgagcgggcggccgacguccgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccgguguccauccccaucaccgccgccgcgugguaccugugggaggucaagaagcagcgcgccggggugcugugggacgugcccagcccgccgcccgucggcaaggccgagcucgaggacggggccuaccggaucaagcagaagggcauccugggguacucccagaucggcgccggcguguacaaggaggggaccuuccacaccauguggcacgugacgcgcggcgcgguccugaugcacaaggggaagcggaucgagcccagcugggccgacgugaagaaggaccucaucuccuacggcgggggcuggaagcuggagggcgaguggaaggagggggaggaggugcagguccuggcccucgagcccggcaagaacccccgcgccgugcagaccaagcccgggcuguucaagaccaacaccggcacgaucggggccgugagccuggacuucucccccggcaccagcggcucccccaucgucgacaagaaggggaagguggugggccucuacgggaacggcgucgugacccggagcggcaccuacguguccgcgaucgcccagacggagaaguccaucgaggacaaccccgagaucgaggacgacaucuuccgcaagaagcggcugaccaucauggaccugcaccccggggccggcaagaccaagcgcuaccugcccgccaucguccgggaggcgaucaagcgcgggcuccggacccugauccuggccccgacgcgcgugguggccgccgagauggaggaggcccuccgcggccugcccauccgguaccagacccccgcgauccgcgccgagcacaccgggcgggagaucgucgaccugaugugccacgccaccuucacgaugcgccuccugagccccauccgggugccgaacuacaaccugaucaucauggacgaggcccacuucaccgaccccgccuccaucgcggcccgcggcuacaucagcacccggguggagaugggcgaggccgccgggaucuucaugaccgccacgccgcccggcucccgcgacccguucccccagagcaacgcgcccaucauggacgaggagcgggagauccccgagcgcuccuggaacagcgggcacgagugggucaccgacuucaagggcaagaccgugugguucgugccguccaucaaggccgggaacgacaucgccgccugccuccggaagaacggcaagaaggucauccagcugagccgcaagaccuucgacuccgaguacaucaagacgcggaccaacgacugggacuucguggugaccaccgacaucagcgagaugggcgcgaacuucaaggccgagcgcgucaucgacccccggcgcugcaugaagcccgugauccugacggacggggaggagcgggugauccucgccggccccaugccggucacccacuccagcgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucuccacccccgagggcaucaucccgagcauguucgagcccgagcgggagaagguggacgccaucgacggcgaguaccgccugcgcggggaggcccgcaagaccuucgucgaccugaugcggcgcggcgaccuccccguguggcuggccuaccgggucgcggccgaggggaucaacuacgccgaccgccgguggugcuucgacggcgugaagaacaaccagauccuggaggagaacguggaggucgagaucuggacgaaggagggggagcgcaagaagcucaagccgcgguggcuggacgcccgcaucuacuccgacccccuggcccucaaggaguucaaggaguucgcggccggccgcaagagccugacccugaaccucaucaccgagaugggccgccugcccaccuucaugacgcagaaggcccggaacgcccuggacaaccucgcggugcugcacaccgccgaggccgggggccgcgccuacaaccacgcccuguccgagcuccccgagacccuggagacccugcuccugcugacgcuccuggcggccgugaccgggggcaucuuccuguuccucaugagcggcaaggggaucggcaagaugacccuggggaugugcugcaucaucaccgccuccauccugcucugguacgcccagauccagccgcacuggaucgccgcgagcaucauccuggaguucuuccugaucguccuccugauccccgagcccgagaagcagcggacgccccaggacaaccagcugacguacguggugaucgccauccucaccgucguggccgccaccauggccaacgagaugggcuuccuggagaagaccaagaaggacuucgggcugggcagcacgaccacccagcagccggaguccaacauccucgacaucgaccugcgccccgcgagcgccuggacccuguacgccguggccacgaccuucaucacccccaugcuccggcacuccaucgagaacagcuccgucaacgugagccugaccgccaucgcgaaccaggccacggugcugaugggccucgggaagggcuggccccuguccaagauggacaucggggucccgcugcucgccaucggcugcuacagccaggugaaccccaucacccugaccgccgcgcugcuccugcugguggcccacuacgccaucaucgggcccggccuccaggccaaggccacccgcgaggcgcagaagcgggccgccgccggcaucaugaagaaccccacggucgacgggaucaccgugaucgaccuggacccgauccccuacgaccccaaguucgagaagcagcugggccaggugaugcuccugguccugugcgugacccaggugcucaugaugcgcaccacgugggcccugugcgaggcgcugacccucgccaccgggcccaucuccacccugugggagggcaacccggggcgcuucuggaacacgaccaucgccgucagcauggccaacaucuuccggggcuccuaccuggccggcgcggggcuccuguucagcaucaugaagaacaccgccaacacccgccggggcacggggaacaccggcgagacccugggcgagaaguggaagaaccgccucaacgcccuggggaaguccgaguuccagaucuacaagaaguccggcauccaggagguggaccggacccuggccaaggaggggaucaagcgcggcgagacggaccaccacgcggugucccgggggagcgccaagcuccgcugguucgucgagcggaaccuggugacccccgagggcaagguggucgaccugggcugcgggcgcggcgggugguccuacuacugcggcgggcucaagaacgugaaggaggugaagggccugaccaagggcgggcccggccacgaggagcccaucccgaugagcaccuacggguggaaccugguccggcuccaguccggcguggacguguucuucacgccgcccgagaagugcgacacccugcugugcgacaucggggagagcagccccaacccgaccgucgaggccggccgcacccuccgggugcugaaccugguggagaacuggcucaacaacaacacccaguucugcaucaagguccugaaccccuacaugcccuccgugaucgagaagauggaggcccugcagcgcaaguacggcggggcccuggugcggaacccgcucagccgcaacuccacgcacgagauguacugggucagcaacgcguccggcaacaucgugagcuccgugaacaugaucagccggaugcugaucaaccgcuucaccaugcggcacaagaaggccaccuacgagcccgacgucgaccugggguccggcacccgcaacaucgggaucgagagcgagacgcccaaccucgacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgugguccggcugcugaccaagccgugggacgugauccccauggugacccagauggccaugaccgacacgacccccuucgggcagcagcgcgucuucaaggagaagguggacacccggacccaggagcccaaggagggcacgaagaagcucaugaagaucaccgcggaguggcuguggaaggagcugggcaagaagaagaccccgcgcaugugcacccgggaggaguucacgcgcaagguccggagcaacgccgcccucggggccaucuucaccgacgagaacaaguggaaguccgcccgcgaggcgguggaggacagcggcuucugggagcugguggacaaggagcggaaccugcaccucgaggggaagugcgagaccugcgucuacaacaugaugggcaagcgcgagaagaagcugggggaguucggcaaggccaagggcucccgggccaucugguacauguggcugggggcccgcuuccucgaguucgaggcgcugggcuuccugaacgaggaccacugguucagccgggagaacagccucuccgggguggagggcgaggggcugcacaagcugggcuacauccuccgcgacgugagcaagaaggagggcggggccauguacgccgacgacaccgccggcugggacacgcggaucacccuggaggaccugaagaacgaggagauggucaccaaccacauggagggggagcacaagaagcucgccgaggcgaucuucaagcugaccuaccagaacaagguggugcgcguccagcggcccacgccccgcggcaccgugauggacaucaucucccggcgcgaccagcgggggagcggccagguggucaccuacggccugaacaccuucacgaacauggaggcccagcucauccgccagauggagggggagggcguguucaaguccauccagcagcugaccgugaccgaggagaucgccgucaagaacuggcuggugcgcguggggcgggagcgccucagccggauggccaucuccggcgacgacugcgucgugaagccccuggacgaccgcuucgccagcgcgcugaccgcccucaacgacaugggcaaggugcggaaggacauccagcagugggagccgucccgcggguggaacgacuggacgcagguccccuucugcagccaccacuuccacgagcugaucaugaaggacggccgggugcuggugguccccugccgcaaccaggacgagcucaucgggcgggcccgcaucucccagggcgccggguggagccugcgggagaccgccugccugggcaaguccuacgcgcagauguggaaccucauguacuuccaccgccgggaccugcgccuggccgccaacgccaucugcagcgccgugcccucccacugggugccgaccagccggaccaccugguccauccacgcgacgcacgaguggaugaccaccgaggacaugcucaccgucuggaaccgcguguggauccaggagaaccccuggauggaggacaagacgcccguggagagcugggaggagauccccuaccugggcaagcgggaggaccaguggugcgggagccugaucggccucaccucccgcgccaccugggccaagaacauccagaccgccaucaaccagguccggagccugaucgggaacgaggaguacacggacuacaugccguccaugaagcgcuuccgccgggaggaggaggaggcgggcgugcugugguga

SEQ ID NO: 9626 - RNA, 9876 nt, Artificial Sequence
  derived and/or modified CDS sequence (opt1) from DENV-2__KP723478__SS-prME
accgccggcaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaagaccuggggcaaggcgaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuucugcgacagcaagcugauguccgccgccaucaaggacaaccgggcggugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgccggccccaugagccagcacaacuaccgcccgggguaccacacccagaccgcgggccccuggcaccucgggcggcuggagauggacuucgacuucugcgagggcacgaccgugguggucaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggugacggccggccacgggcagaucgacaacuucagccucggcguccugggcauggcccuguuccucgaggagaugcugcgcacccggguggggaccaagcacgcgauccugcucguggccgucuccuucgugacccugaucacgggcaacaugagcuuccgcgaccuggggcgcgugauggucauggugggcgccgccaugaccgacgacaucgggaugggcgugaccuaccucgcccugcuggcggccuucaagguccggcccaccuucgccgccggccuccugcugcgcaagcucacguccaaggagcugaugaugaccaccaucgggaucgugcugcucagccaguccaccaugcccgagacgauccuggagcugaccgacgcccucgcgcugggcaugauggugcugaagaucguccggaacauggagaaguaccagcucgccgugaccaucauggccauccugugcgucccgaacgccgugauccugcagaacgccuggaaggugagcugcaccacgcucgcggucguguccgugagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgucggcauggugagcauccuggccuccagccugcucaagaacgacauccccaugaccggcccccugguggccgggggccugcucacggucugcuacgugcugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugacgauccucauccggaccggccugcuggucaucagcggccucuucccgguguccacccccaucaccgccgccgcgugguaccugugggaggugaagaagcagcgcgccgggguccugugggacgugcccagcccgccgcccgugggcaaggccgagcucgaggacggggccuaccggaucaagcagaagggcauccugggguacucccagaucggcgccggcgucuacaaggaggggaccuuccacacgauguggcacgugacccgcggcgcggugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagaccaacacgggcaccaucggggccgugagccuggacuucucccccggcaccagcggcucccccaucguggacaagaaggggaaggucgugggccucuacgggaacggcguggucacccggagcggcacguacguguccgcgaucgcccagaccgagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacgcugauccuggccccgacccgcgucguggccgccgagauggaggaggcccuccgcggccugcccauccgguaccagacccccgcgauccgcgccgagcacaccgggcgggagaucguggaccugaugugccacgccacguucaccaugcgccuccugagccccauccgggucccgaacuacaaccugaucaucauggacgaggcccacuucaccgaccccgccuccaucgcggcccgcggcuacaucagcacccggguggagaugggcgaggccgccgggaucuucaugacggccacgccgcccggcucccgcgacccguucccccagagcaacgcgcccaucauggacgaggagcgggagauccccgagcgcuccuggaacagcgggcacgagugggugaccgacuucaagggcaagaccgucugguucgugccguccaucaaggccgggaacgacaucgccgccugccuccggaagaacggcaagaaggugauccagcugagccgcaagacguucgacuccgaguacaucaagacccggaccaacgacugggacuucgucgugaccacggacaucagcgagaugggcgcgaacuucaaggccgagcgcgugaucgacccccggcgcugcaugaagcccgucauccugaccgacggggaggagcgggugauccucgccggccccaugccggugacccacuccagcgccgcccagcgccgggggcgcgucggccgcaaccccaagaacgagaacgaccaguacaucuacaugggggagccccuggagaacgacgaggacugcgcgcacuggaaggaggccaagaugcugcucgacaacaucuccacccccgagggcaucaucccgagcauguucgagcccgagcgggagaagguggacgccaucgacggcgaguaccgccugcgcggggaggcccgcaagacguucguggaccugaugcggcgcggcgaccuccccgucuggcuggccuaccggguggcggccgaggggaucaacuacgccgaccgccgguggugcuucgacggcgucaagaacaaccagauccuggaggagaacguggagguggagaucuggaccaaggagggggagcgcaagaagcucaagccgcgguggcuggacgcccgcaucuacuccgacccccuggcccucaaggaguucaaggaguucgcggccggccgcaagagccugacccugaaccucaucaccgagaugggccgccugcccacguucaugacccagaaggcccggaacgcccuggacaaccucgcgguccugcacaccgccgaggccgggggccgcgccuacaaccacgcccuguccgagcuccccgagacccuggagacgcugcuccugcugacccuccuggcggccgugaccgggggcaucuuccuguuccucaugagcggcaaggggaucggcaagaugacccuggggaugugcugcaucaucaccgccuccauccugcucugguacgcccagauccagccgcacuggaucgccgcgagcaucauccuggaguucuuccugaucgugcuccugauccccgagcccgagaagcagcggacgccccaggacaaccagcugaccuacgucgugaucgccauccucaccguggucgccgccaccauggccaacgagaugggcuuccuggagaagacgaagaaggacuucgggcugggcagcaccaccacccagcagccggaguccaacauccucgacaucgaccugcgccccgcgagcgccuggacgcuguacgccguggccaccaccuucaucacccccaugcuccggcacuccaucgagaacagcuccgugaacgucagccugacggccaucgcgaaccaggccaccgugcugaugggccucgggaagggcuggccccuguccaagauggacaucggggugccgcugcucgccaucggcugcuacagccaggucaaccccaucacccugaccgccgcgcugcuccugcugguggcccacuacgccaucaucgggcccggccuccaggccaaggccacgcgcgaggcgcagaagcgggccgccgccggcaucaugaagaaccccaccguggacgggaucaccgucaucgaccuggacccgauccccuacgaccccaaguucgagaagcagcugggccaggugaugcuccuggugcugugcgucacccaggugcucaugaugcgcacgaccugggcccugugcgaggcgcugacccucgccaccgggcccaucuccacgcugugggagggcaacccggggcgcuucuggaacaccaccaucgccgugagcauggccaacaucuuccggggcuccuaccuggccggcgcggggcuccuguucagcaucaugaagaacaccgccaacacgcgccggggcaccgggaacaccggcgagacccugggcgagaaguggaagaaccgccucaacgcccuggggaaguccgaguuccagaucuacaagaaguccggcauccaggaggucgaccggacgcuggccaaggaggggaucaagcgcggcgagaccgaccaccacgcggugucccgggggagcgccaagcuccgcugguucguggagcggaaccuggucacccccgagggcaaggugguggaccugggcugcgggcgcggcgggugguccuacuacugcggcgggcucaagaacgucaaggaggugaagggccugaccaagggcgggcccggccacgaggagcccaucccgaugagcacguacggguggaaccuggugcggcuccaguccggcgucgacguguucuucacgccgcccgagaagugcgacacccugcugugcgacaucggggagagcagccccaacccgaccguggaggccggccgcacccuccggguccugaaccugguggagaacuggcucaacaacaacacgcaguucugcaucaaggugcugaaccccuacaugcccuccgucaucgagaagauggaggcccugcagcgcaaguacggcggggcccuggugcggaacccgcucagccgcaacuccacccacgagauguacugggugagcaacgcguccggcaacaucgucagcuccgugaacaugaucagccggaugcugaucaaccgcuucaccaugcggcacaagaaggccaccuacgagcccgacguggaccugggguccggcacgcgcaacaucgggaucgagagcgagacccccaaccucgacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggucaacggcguggugcggcugcugaccaagccgugggacgucauccccauggugacccagauggccaugacggacaccacccccuucgggcagcagcgcguguucaaggagaaggucgacacccggacgcaggagcccaaggagggcaccaagaagcucaugaagaucaccgcggaguggcuguggaaggagcugggcaagaagaagaccccgcgcaugugcacgcgggaggaguucacccgcaaggugcggagcaacgccgcccucggggccaucuucaccgacgagaacaaguggaaguccgcccgcgaggcggucgaggacagcggcuucugggagcugguggacaaggagcggaaccugcaccucgaggggaagugcgagaccugcguguacaacaugaugggcaagcgcgagaagaagcugggggaguucggcaaggccaagggcucccgggccaucugguacauguggcugggggcccgcuuccucgaguucgaggcgcugggcuuccugaacgaggaccacugguucagccgggagaacagccucuccggggucgagggcgaggggcugcacaagcugggcuacauccuccgcgacgugagcaagaaggagggcggggccauguacgccgacgacacggccggcugggacacccggaucacccuggaggaccugaagaacgaggagauggugaccaaccacauggagggggagcacaagaagcucgccgaggcgaucuucaagcugacguaccagaacaaggucgugcgcgugcagcggcccacgccccggggcaccgucauggacaucaucucccggcgcgaccagcgggggagcggccagguggugaccuacggccugaacacguucaccaacauggaggcccagcucauccgccagauggagggggagggcgucuucaaguccauccagcagcugaccgugaccgaggagaucgccgugaagaacuggcugguccgcguggggcgggagcgccucagccggauggccaucuccggcgacgacugcguggucaagccccuggacgaccgcuucgccagcgcgcugacggcccucaacgacaugggcaaggugcggaaggacauccagcagugggagccgucccgcggguggaacgacuggacccaggugcccuucugcagccaccacuuccacgagcugaucaugaaggacggccggguccugguggugcccugccgcaaccaggacgagcucaucgggcgggcccgcaucucccagggcgccggguggagccugcgggagaccgccugccugggcaaguccuacgcgcagauguggaaccucauguacuuccaccgccgggaccugcgccuggccgccaacgccaucugcagcgccguccccucccacugggugccgaccagccggaccacgugguccauccacgcgacccacgaguggaugaccaccgaggacaugcucacgguguggaaccgcgucuggauccaggagaaccccuggauggaggacaagacccccguggagagcugggaggagauccccuaccugggcaagcgggaggaccaguggugcgggagccugaucggccucaccucccgcgccaccugggccaagaacauccagacggccaucaaccaggugcggagccugaucgggaacgaggaguacaccgacuacaugccguccaugaagcgcuuccgccgggaggaggaggaggcgggcguccugugguga

SEQ ID NO: 9627 - RNA, 9876 nt, Artificial Sequence
  derived and/or modified CDS sequence (opt1) from DENV-2__KP723479__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccacccgggguucaccaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggagguggaggacuacggguucggcguguucaccaccaacaucuggcucaagaugaaggagcgccaggacgucuucugcgacagcaagcugauguccgccgcgaucaaggacagccgggccgugcacgccgacaugggguacuggaucgaguccgcccugaacgacacguggaagaucgagaaggccagcuucaucgaggugaaguccugccacuggcccaagagccacacccucugguccaacggcguccuggagagcgagaugaucauccccaagaacuucgcgggccccgugagccagcacaacuaccgcccgggguaccacacccagaccgccggccccuggcaccuggggcggcucgagauggacuucgacuucugcgagggcaccacgguggucgugaccgaggacugcgggaaccgcggccccucccugcggaccaccacggccagcggcaagcugaucaccgaguggugcugccgcuccugcacccugccgccccugcgguaccgcggggaggacggcugcugguacgggauggagauccggccccugaaggagaaggaggagaaccucgugaacagccuggucaccgccggccacgggcagaucgacaacuucucccugggcgugcucggcauggcgcuguuccuggaggagaugcuccgcacgcggguggggaccaagcacgccauccugcuggucgccgugagcuucgugacccucaucaccggcaacauguccuuccgcgaccuggggcgcgucauggugauggugggcgccacgaugaccgacgacaucgggaugggcgucaccuaccuggcccuccuggcggccuucaaggugcggcccaccuucgccgccggccugcuccugcgcaagcugacgagcaaggagcucaugaugaccaccaucgggaucgugcugcugucccaggccaccauccccgagacgauccucgagcugaccgacgcgcuggcccucggcaugaugguccugaagaucgugcggaacauggagaaguaccagcuggccgucaccaucauggccauccucugcgugcccaacgccgugauccugcagaacgcguggaaggucagcugcaccacgcuggccgugguguccgucagcccccuccugcugaccuccagccagcagaaggccgacuggaucccccucgcccugaccaucaaggggcugaaccccaccgcgaucuuccucacgacccugucccgcaccaacaagaagcggagcuggccgcugaacgaggccaucauggccgugggcaugguguccauccucgccagcucccugcugaagaacgacauccccaugaccggcccccucgucgccgggggccugcugacggugugcuacgugcucaccgggcgcagcgcggaccuggagcuggagcgggccgccgacguccgcugggaggagcaggccgagaucagcggcuccagccccauccucuccaucaccaucagcgaggacggguccaugagcaucaagaacgaggaggaggagcagacccugacgauccugauccggaccggccuccuggugguguccggccuguucccggucagcacccccaucaccgccgcggccugguaccucugggaggugaagaagcagcgcgccggggugcugugggacguccccagcccgccgcccgugggcaaggccgagcuggaggacggggccuaccggaucaagcagaagggcauccucggguacagccagaucggcgcgggcguguacaaggaggggaccuuccacacgauguggcacgucacccgcggcgccgugcugaugcacaaggggaagcggaucgagcccuccugggccgacgugaagaaggaccugaucagcuacggcgggggcuggaagcucgagggcgaguggaaggagggggaggagguccaggugcuggcccuggagcccggcaagaacccccgcgccgugcagaccaagcccggccucuucaagaccaacacgggcaccaucggggcggucucccuggacuucagccccggcaccuccggcagccccaucguggacaagaaggggaagguggucggccuguacgggaacggcguggugacccgguccggcacguacgucagcgccaucgcccagaccgagaaguccaucgaggacaaccccgagaucgaggacgacaucuuccgcaagaagcggcucaccaucauggaccugcaccccggggccggcaagaccaagcgcuaccugcccgcgaucgugcgggaggccaucaagcgcgggcugcggacgcucauccuggccccgacccgcguggucgccgccgagauggaggaggcgcugcgcggccuccccauccgguaccagacccccgccauccgcgccgagcacaccgggcgggagaucguggaccugaugugccacgccacguucaccaugcgccugcucagccccauccgggugccgaacuacaaccugaucaucauggacgaggcccacuucaccgaccccgcgagcaucgccgcccgcggcuacaucuccacccgggucgagaugggcgaggccgccgggaucuucaugacggcgacgccgcccggcagccgcgacccguucccccaguccaacgcccccaucauggacgaggagcgggagauccccgagcgcagcuggaacuccgggcacgagugggugaccgacuucaagggcaagaccgugugguucgucccgagcaucaaggccgggaacgacaucgccgcgugccugcggaagaacggcaagaaggugauccagcucucccgcaagacguucgacagcgaguacaucaagacccggaccaacgacugggacuucguggucaccacggacaucuccgagaugggcgccaacuucaaggccgagcgcgugaucgacccccggcgcugcaugaagcccgugauccugaccgacggggaggagcgggucauccuggccggccccaugccggugacccacagcuccgccgcgcagcgccgggggcgcgugggccgcaaccccaagaacgagaacgaccaguacaucuacaugggggagccccucgagaacgacgaggacugcgcccacuggaaggaggccaagaugcugcuggacaacaucaacacccccgagggcaucaucccgagcauguucgagcccgagcgggagaaggucgacgccaucgacggcgaguaccgccuccgcggggaggcccgcaagacguucguggaccugaugcggcgcggcgaccugcccgucuggcucgcguaccggguggccgccgaggggaucaacuacgccgaccgccgguggugcuucgacggcgugaagaacaaccagauccuggaggagaacgucgagguggagaucuggaccaaggagggggagcgcaagaagcugaagccgcgguggcucgacgcccgcaucuacuccgacccccuggcgcugaaggaguucaaggaguucgccgccggccgcaagagccucacccugaaccugaucaccgagaugggccggcuccccacguucaugacccagaaggcccggaacgcgcuggacaaccuggccgugcuccacaccgccgaggccgggggccgcgccuacaaccacgcgcuguccgagcugcccgagacccucgagacgcugcugcuccugacccugcucgccaccgucaccgggggcaucuuccuguuccugaugagcggcaaggggaucggcaagaugacccucgggaugugcugcaucaucacggccuccauccugcugugguacgcccagauccagccgcacuggaucgccgcgagcaucauccucgaguucuuccugaucgugcugcucauccccgagcccgagaagcagcggacgccccaggacaaccagcugaccuacguggucaucgccauccugaccgugguggccgccacgauggccaacgagaugggcuuccucgagaagaccaagaaggacuucgggcugggcuccaucaccacccagcagccggagaacaacauccuggacaucgaccuccgccccgcgagcgccuggacgcuguacgccgucgccaccaccuucaucacccccaugcugcggcacagcaucgagaacuccagcgugaacgugucccucacggccaucgcgaaccaggccaccguccugaugggccuggggaagggcuggccccucagcaagauggacaucggggugccgcugcuggccaucggcugcuacucccaggugaaccccaucacccucaccgccgcgcugcugcuccuggucgcccacuacgccaucaucgggcccggccugcaggccaaggccacgcgcgaggcgcagaagcgggccgccgccggcaucaugaagaaccccaccguggacgggaucaccgugaucgaccucgacccgauccccuacgaccccaaguucgagaagcagcugggccaggucaugcugcucgugcugugcgugacccagguccugaugaugcgcacgaccugggcccucugcgaggcgcugacccuggccaccgggcccaucagcacgcucugggagggcaacccggggcgcuucuggaacaccaccaucgccguguccauggccaacaucuuccggggcagcuaccuggccggcgcggggcuccucuucuccaucaugaagaacaccgccaacacgcgccggggcaccgggaacaccggcgagacccugggcgagaaguggaagaaccgccugaacgcccucgggaaguccgaguuccagaucuacaagaaguccggcauccaggagguggaccggacgcuggccaaggaggggaucaagcgcggcgagaccgaccaccacgcggucagccggggguccgccaagcugcgcugguucguggagcggaaccucgugacccccgagggcaaggucguggaccugggcugcgggcgcggcggguggagcuacuacugcggcgggcugaagaacgugaaggaggucaagggccucaccaagggcgggcccggccacgaggagcccaucccgauguccacguacggguggaaccuggugcggcugcagagcggcguggacgucuucuucacgccgcccgagaagugcgacacccuccugugcgacaucggggaguccagccccaacccgaccguggaggccggccgcacccugcgggugcucaaccuggucgagaacuggcugaacaacaacacgcaguucugcaucaaggugcucaaccccuacaugcccuccgugaucgagaagauggaggcccugcagcgcaaguacggcggggcccugguccggaacccgcugagccgcaacagcacccacgagauguacuggguguccaacgcgagcggcaacaucguguccagcgucaacaugaucucccggaugcucaucaaccgcuucaccaugcggcacaagaaggccaccuacgagcccgacguggaccuggggagcggcacgcgcaacaucgggaucgaguccgagacccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgucgugcggcuccugaccaagccgugggacgugauccccauggucacccagauggccaugacggacaccacccccuucgggcagcagcgcguguucaaggagaaggucgacacccggacgcaggagcccaaggagggcaccaagaagcugaugaagaucaccgcggaguggcucuggaaggagcugggcaagaagaagaccccgcgcaugugcacgcgggaggaguucacccgcaaggugcgguccaacgccgcccugggggccaucuucaccgacgagaacaaguggaaguccgcccgcgaggcgguggaggacuccggcuucugggagcucgucgacaaggagcggaaccugcaccuggaggggaagugcgagaccugcguguacaacaugaugggcaagcgcgagaagaagcucggggaguucggcaaggccaagggcagccgggccaucugguacauguggcugggggcccgcuuccuggaguucgaggcgcucggcuuccugaacgaggaccacugguucucccgggagaacagccuguccgggguggagggcgaggggcuccacaagcugggcuacauccugcgcgacgucagcaagaaggagggcggggccauguacgccgacgacacggccggcugggacacccggaucacccucgaggaccugaagaacgaggagauggugaccaaccacauggagggggagcacaagaagcuggccgaggcgaucuucaagcucacguaccagaacaaggugguccgcgugcagcggcccacgccccgcggcaccgugauggacaucaucagccggcgcgaccagcggggguccggccaggucgugaccuacggccugaacaccuucaccaacauggaggcccagcugauccgccagauggagggggagggcguguucaagagcauccagcagcucaccgucaccgaggagaucgccgugaagaacuggcuggugcgcgucgggcgggagcgccugucccggauggccaucagcggcgacgacugcguggugaagccccucgacgaccgcuucgccuccgcgcugacggcccugaacgacaugggcaagguccggaaggacauccagcagugggagccgagccgcggguggaacgacuggacccaggugcccuucugcucccaccacuuccacgagcucaucaugaaggacggccgggugcuggucgugcccugccgcaaccaggacgagcugaucgggcgggcccgcaucagccagggcgccggguggucccuccgggagaccgccugccugggcaagagcuacgcgcagauguggucccugauguacuuccaccgccgggaccuccgccuggccgccaacgccaucugcagcgccgugcccucccacugggucccgaccagccggaccacgugguccauccacgcgacccacgaguggaugaccaccgaggacaugcugacgguguggaaccgcguguggauccaggagaaccccuggauggaggacaagacccccgucgagagcugggaggagauccccuaccucggcaagcgggaggaccaguggugcgggucccugaucggccugaccagccgcgccaccugggccaagaacauccagacggccaucaaccaggugcggagccucaucgggaacgaggaguacaccgacuacaugccguccaugaagcgcuuccgccgggaggaggaggaggcgggcgugcugugguga

SEQ ID NO: 9628 - RNA, 9876 nt, Artificial Sequence
  derived and/or modified CDS sequence (opt1) from DENV-2__KT187554__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaagaccuggggcaaggcgaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuucugcgacagcaagcugauguccgccgccaucaaggacaaccgggcggugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgcgggccccuggcaccucgggcggcuggagauggacuucgacuucugcgagggcacgaccguggucgugaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggucacggccggccacgggcagaucgacaacuucagccucggcgugcugggcauggcccuguuccucgaggagaugcugcgcacccggguggggaccaagcacgcgauccugcucgucgccguguccuucgugacccugaucacgggcaacaugagcuuccgcgaccuggggcgcgucauggugauggugggcgccgccaugaccgacgacaucgggaugggcgucaccuaccucgcccugcuggcggccuucaaggugcggcccaccuucgccgccggccuccugcugcgcaagcucacguccaaggagcugaugaugaccaccaucgggaucgugcugcucagccaguccaccaugcccgagacgauccuggagcugaccgacgcccucgcgcugggcaugaugguccugaagaucgugcggaacauggagaaguaccagcucgccgucaccaucauggccauccugugcgugccgaacgccgugauccugcagaacgccuggaaggucagcugcaccacgcucgcggugguguccgucagcccccuguuccugaccuccagccagcagaaggccgacuggaucccccucgcccugaccaucaaggggcugaaccccaccgccaucuuccucacgacccugucccgcaccagcaagaagcgguccuggccgcugaacgaggcgaucauggccgugggcauggugagcauccucgccuccagccugcugaagaacgacauccccaugaccggcccccucgucgccgggggccugcugacggugugcuacgugcucaccgggcgcagcgccgaccuggagcuggagcgggcggccgacguccgcugggaggagcaggccgagaucuccggcagcucccccauccucagcaucaccaucuccgaggacgggagcauguccaucaagaacgaggaggaggagcagacccugacgauccugauccggaccggccuccuggugaucagcggccuguucccgguguccauccccaucaccgccgccgcgugguaccucugggaggucaagaagcagcgcgccggggugcugugggacgugcccagcccgccgcccgucggcaaggccgagcuggaggacggggccuaccggaucaagcagaagggcauccucggguacucccagaucggcgccggcguguacaaggaggggaccuuccacaccauguggcacgugacgcgcggcgcgguccugaugcacaaggggaagcggaucgagcccagcugggccgacgugaagaaggaccugaucuccuacggcgggggcuggaagcucgagggcgaguggaaggagggggaggaggugcagguccuggcccuggagcccggcaagaacccccgcgccgugcagaccaagcccggccuguucaagaccaacaccggcacgaucggggccgugagccuggacuucucccccggcaccagcggcucccccaucgucgacaagaaggggaagguggugggccuguacgggaacggcgucgugacccggagcggcaccuacguguccgcgaucgcccagacggagaaguccaucgaggacaaccccgagaucgaggacgacaucuuccgcaagaagcggcucaccaucauggaccugcaccccggggccggcaagaccaagcgcuaccugcccgccaucguccgggaggcgaucaagcgcgggcugcggacccucauccuggccccgacgcgcgugguggccgccgagauggaggaggcccugcgcggccuccccauccgguaccagacccccgcgauccgcgccgagcacaccgggcgggagaucgucgaccugaugugccacgccaccuucacgaugcgccugcucagccccauccgggugccgaacuacaaccugaucaucauggacgaggcccacuucaccgaccccgccuccaucgcggcccgcggcuacaucagcacccggguggagaugggcgaggccgccgggaucuucaugaccgccacgccgcccggcucccgcgacccguucccccagagcaacgcgcccaucauggacgaggagcgggagauccccgagcgcuccuggaacagcgggcacgagugggucaccgacuucaagggcaagaccgugugguucgugccguccaucaaggccgggaacgacaucgccgccugccugcggaagaacggcaagaaggucauccagcucagccgcaagaccuucgacuccgaguacaucaagacgcggaccaacgacugggacuucguggugaccaccgacaucagcgagaugggcgcgaacuucaaggccgagcgcgucaucgacccccggcgcugcaugaagcccgugauccugacggacggggaggagcgggugauccuggccggccccaugccggucacccacuccagcgccgcccagcgccgggggcgcgugggccgcaaccccaagaacgagaacgaccaguacaucuacaugggggagccccucgagaacgacgaggacugcgcgcacuggaaggaggccaagaugcugcuggacaacaucuccacccccgagggcaucaucccgagcauguucgagcccgagcgggagaagguggacgccaucgacggcgaguaccgccuccgcggggaggcccgcaagaccuucgucgaccugaugcggcgcggcgaccugcccguguggcucgccuaccgggucgcggccgaggggaucaacuacgccgaccgccgguggugcuucgacggcgugaagaacaaccagauccuggaggagaacguggaggucgagaucuggacgaaggagggggagcgcaagaagcugaagccgcgguggcucgacgcccgcaucuacuccgacccccuggcccugaaggaguucaaggaguucgcggccggccgcaagagccucacccugaaccugaucaccgagaugggccgccuccccaccuucaugacgcagaaggcccggaacgcccuggacaaccuggcggugcuccacaccgccgaggccgggggccgcgccuacaaccacgcccuguccgagcugcccgagacccucgagacccugcugcuccugacgcugcucgcggccgugaccgggggcaucuuccuguuccugaugagcggcaaggggaucggcaagaugacccucgggaugugcugcaucaucaccgccuccauccugcugugguacgcccagauccagccgcacuggaucgccgcgagcaucauccucgaguucuuccugaucguccugcucauccccgagcccgagaagcagcggacgccccaggacaaccagcugacguacguggugaucgccauccugaccgucguggccgccaccauggccaacgagaugggcuuccucgagaagaccaagaaggacuucgggcugggcagcacgaccacccagcagccggaguccaacauccuggacaucgaccuccgccccgcgagcgccuggacccuguacgccguggccacgaccuucaucacccccaugcugcggcacuccaucgagaacagcuccgucaacgugagccucaccgccaucgcgaaccaggccacggugcugaugggccuggggaagggcuggccccucuccaagauggacaucggggucccgcugcuggccaucggcugcuacagccaggugaaccccaucacccucaccgccgcgcugcugcuccugguggcccacuacgccaucaucgggcccggccugcaggccaaggccacccgcgaggcgcagaagcgggccgccgccggcaucaugaagaaccccacggucgacgggaucaccgugaucgaccucgacccgauccccuacgaccccaaguucgagaagcagcugggccaggugaugcugcucguccugugcgugacccaggugcugaugaugcgcaccacgugggcccucugcgaggcgcugacccuggccaccgggcccaucuccacccucugggagggcaacccggggcgcuucuggaacacgaccaucgccgucagcauggccaacaucuuccggggcuccuaccuggccggcgcggggcuccucuucagcaucaugaagaacaccgccaacacccgccggggcacggggaacaccggcgagacccugggcgagaaguggaagaaccgccugaacgcccucgggaaguccgaguuccagaucuacaagaaguccggcauccaggagguggaccggacccuggccaaggaggggaucaagcgcggcgagacggaccaccacgcggugucccgggggagcgccaagcugcgcugguucgucgagcggaaccucgugacccccgagggcaagguggucgaccugggcugcgggcgcggcgggugguccuacuacugcggcgggcugaagaacgugaaggaggugaagggccucaccaagggcgggcccggccacgaggagcccaucccgaugagcaccuacggguggaaccugguccggcugcaguccggcguggacguguucuucacgccgcccgagaagugcgacacccuccugugcgacaucggggagagcagccccaacccgaccgucgaggccggccgcacccugcgggugcucaaccugguggagaacuggcugaacaacaacacccaguucugcaucaagguccucaaccccuacaugcccuccgugaucgagaagauggaggcccugcagcgcaaguacggcggggcccuggugcggaacccgcugagccgcaacuccacgcacgagauguacugggucagcaacgcguccggcaacaucgugagcuccgugaacaugaucagccggaugcucaucaaccgcuucaccaugcggcacaagaaggccaccuacgagcccgacgucgaccugggguccggcacccgcaacaucgggaucgagagcgagacgcccaaccuggacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgugguccggcuccugaccaagccgugggacgugauccccauggugacccagauggccaugaccgacacgacccccuucgggcagcagcgcgucuucaaggagaagguggacacccggacccaggagcccaaggagggcacgaagaagcugaugaagaucaccgcggaguggcucuggaaggagcugggcaagaagaagaccccgcgcaugugcacccgggaggaguucacgcgcaagguccggagcaacgccgcccugggggccaucuucaccgacgagaacaaguggaaguccgcccgcgaggcgguggaggacagcggcuucugggagcucguggacaaggagcggaaccugcaccuggaggggaagugcgagaccugcgucuacaacaugaugggcaagcgcgagaagaagcucggggaguucggcaaggccaagggcucccgggccaucugguacauguggcugggggcccgcuuccuggaguucgaggcgcucggcuuccugaacgaggaccacugguucagccgggagaacagccuguccgggguggagggcgaggggcuccacaagcugggcuacauccugcgcgacgugagcaagcgggagggcggggccauguacgccgacgacaccgccggcugggacacgcgcaucacccucgaggaccugaagaacgaggagauggucaccaaccacauggagggggagcacaagaagcuggccgaggcgaucuucaagcucaccuaccagaacaagguggugcggguccagcgccccacgccccggggcaccgugauggacaucaucucccgccgggaccagcgcgggagcggccagguggucaccuacggccugaacaccuucacgaacauggaggcccagcugauccgccagauggagggggagggcguguucaaguccauccagcagcucaccgugaccgaggagaucgccgucaagaacuggcuggugcggguggggcgcgagcggcugagccgcauggccaucuccggcgacgacugcgucgugaagccccucgacgaccgguucgccagcgcgcugaccgcccugaacgacaugggcaaggugcgcaaggacauccagcagugggagccgucccggggguggaacgacuggacgcagguccccuucugcagccaccacuuccacgagcucaucaugaaggacggccgcgugcuggugguccccugccggaaccaggacgagcugaucgggcgcgcccggaucucccagggcgccggguggagccuccgcgagaccgccugccugggcaaguccuacgcgcagauguggaaccugauguacuuccaccggcgcgaccuccggcuggccgccaacgccaucugcagcgccgugcccucccacugggugccgaccagccgcaccaccugguccauccacgcgacgcacgaguggaugaccaccgaggacaugcugaccgucuggaaccggguguggauccaggagaaccccuggauggaggacaagacgcccguggagagcugggaggagauccccuaccucggcaagcgcgaggaccaguggugcgggagccugaucggccugaccucccgggccaccugggccaagaacauccagaccgccaucaaccagguccgcagccucaucgggaacgaggaguacacggacuacaugccguccaugaagcgcuuccggcgcgaggaggaggaggcgggcgugcugugguga

SEQ ID NO: 9629 - RNA, 9876 nt, Artificial Sequence
  derived and/or modified CDS sequence (opt1) from DENV-2__KT187557__SS-prME
accgccggcaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccggcagaacgagcccgaggacaucgacugcuggugcaacagcaccagcaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaagaccuggggcaaggcgaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuucugcgacagcaagcugauguccgccgccaucaaggacaaccgggcggugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgccggccccaugagccagcacaacuaccgcccgggguaccacacccagaccgcgggccccuggcaccucgggcggcuggagauggacuucgacuucugcgagggcacgaccgugguggucaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggugacggccggccacgggcagaucgacaacuucagccucggcguccugggcauggcccuguuccucgaggagaugcugcgcacccggguggggaccaagcacgcgauccugcucguggccgucuccuucgugacccugaucacgggcaacaugagcuuccgcgaccuggggcgcgugauggucauggugggcgccgccaugaccgacgacaucgggaugggcgugaccuaccucgcccugcuggcggccuucaagguccggcccaccuucgccgccggccuccugcugcgcaagcucacguccaaggagcugaugaugaccaccaucgggaucgugcugcucagccaguccaccaugcccgagacgauccuggagcugaccgacgcccucgcgcugggcaugauggugcugaagaucguccggaacauggagaaguaccagcucgccgugaccaucauggccauccugugcgucccgaacgccgugauccugcagaacgccuggaaggugagcugcaccacgcucgcggucguguccgugagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgucggcauggugagcauccuggccuccagccugcucaagaacgacauccccaugaccggcccccugguggccgggggccugcucacggucugcuacgugcugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugacgauccucauccggaccggccugcuggucaucagcggccucuucccgguguccauccccaucaccgccgccgcgugguaccugugggaggugaagaagcagcgcgccgggguccugugggacgugcccagcccgccgcccgugggcaaggccgagcucgaggacggggccuaccggaucaagcagaagggcauccugggguacucccagaucggcgccggcgucuacaaggaggggaccuuccacaccauguggcacgugacgcgcggcgcggugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagaccaacaccggcacgaucggggccgugagccuggacuucucccccggcaccagcggcucccccaucguggacaagaaggggaaggucgugggccucuacgggaacggcguggucacccggagcggcaccuacguguccgcgaucgcccagacggagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcgucguggccgccgagauggaggaggcccuccgcggccugcccauccgguaccagacccccgcgauccgcgccgagcacaccgggcgggagaucguggaccugaugugccacgccaccuucacgaugcgccuccugagccccauccgggucccgaacuacaaccugaucaucauggacgaggcccacuucaccgaccccgccuccaucgcggcccgcggcuacaucagcacccggguggagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugaccgacuucaagggcaagaccgucugguucgugccguccaucaaggccgggaacgacaucgccgccugccuccggaagaacggcaagaaggugauccagcugagccgcaagaccuucgacuccgaguacaucaagacgcggaccaacgacugggacuucgucgugaccaccgacaucagcgagaugggcgcgaacuucaaggccgagcgcgugaucgacccccggcgcugcaugaagcccgucauccugacggacggggaggagcgggugauccucgccggccccaugccggugacccacuccagcgccgcccagcgccgggggcgcgucggccgcaaccccaagaacgagaacgaccaguacaucuacaugggggagccccuggagaacgacgaggacugcgcgcacuggaaggaggccaagaugcugcucgacaacaucuccacccccgagggcaucaucccgagcauguucgagcccgagcgggagaagguggacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgucaagaacaaccagauccuggaggagaacguggagguggagaucuggacgaaggagggggagcgcaagaagcucaagccgcgguggcuggacgcccgcaucuacuccgacccccuggcccucaaggaguucaaggaguucgcggccggccgcaagagccugacccugaaccucaucaccgagaugggccgccugcccaccuucaugacgcagaaggcccggaacgcccuggacaaccucgcgguccugcacaccgccgaggccgggggccgcgccuacaaccacgcccuguccgagcuccccgagacccuggagacccugcuccugcugacgcuccuggcggccgugaccgggggcaucuuccuguuccucaugagcggcaaggggaucggcaagaugacccuggggaugugcugcaucaucaccgccuccauccugcucugguacgcccagauccagccgcacuggaucgccgcgagcaucauccuggaguucuuccugaucgugcuccugauccccgagcccgagaagcagcggacgccccaggacaaccagcugacguacgucgugaucgccauccucaccguggucgccgccaccauggccaacgagaugggcuuccuggagaagaccaagaaggacuucgggcugggcagcacgaccacccagcagccggaguccaacauccucgacaucgaccugcgccccgcgagcgccuggacccuguacgccguggccacgaccuucaucacccccaugcuccggcacuccaucgagaacagcuccgugaacgucagccugaccgccaucgcgaaccaggccacggugcugaugggccucgggaagggcuggccccuguccaagauggacaucggggugccgcugcucgccaucggcugcuacagccaggucaaccccaucacccugaccgccgcgcugcuccugcugguggcccacuacgccaucaucgggcccggccuccaggccaaggccacccgcgaggcgcagaagcgggccgccgccggcaucaugaagaaccccacgguggacgggaucaccgucaucgaccuggacccgauccccuacgaccccaaguucgagaagcagcugggccaggugaugcuccuggugcugugcgucacccaggugcucaugaugcgcaccacgugggcccugugcgaggcgcugacccucgccaccgggcccaucuccacccugugggagggcaacccggggcgcuucuggaacacgaccaucgccgugagcauggccaacaucuuccggggcuccuaccuggccggcgcggggcuccuguucagcaucaugaagaacaccgccaacacccgccggggcacggggaacaccggcgagacccugggcgagaaguggaagaaccgccucaacgcccuggggaaguccgaguuccagaucuacaagaaguccggcauccaggaggucgaccggacccuggccaaggaggggaucaagcgcggcgagacggaccaccacgcggugucccgggggagcgccaagcuccgcugguucguggagcggaaccuggucacccccgagggcaaggugguggaccugggcugcgggcgcggcgggugguccuacuacugcggcgggcucaagaacgucaaggaggugaagggccugaccaagggcgggcccggccacgaggagcccaucccgaugagcaccuacggguggaaccuggugcggcuccaguccggcgucgacguguucuucacgccgcccgagaagugcgacacccugcugugcgacaucggggagagcagccccaacccgaccguggaggccggccgcacccuccggguccugaaccugguggagaacuggcucaacaacaacacccaguucugcaucaaggugcugaaccccuacaugcccuccgucaucgagaagauggaggcccugcagcgcaaguacggcggggcccuggugcggaacccgcucagccgcaacuccacgcacgagauguacugggugagcaacgcguccggcaacaucgucagcuccgugaacaugaucagccggaugcugaucaaccgcuucaccaugcggcacaagaaggccaccuacgagcccgacguggaccugggguccggcacccgcaacaucgggaucgagagcgagacgcccaaccucgacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggucaacggcguggugcggcugcugaccaagccgugggacgucauccccauggugacccagauggccaugaccgacacgacccccuucgggcagcagcgcguguucaaggagaaggucgacacccggacccaggagcccaaggagggcacgaagaagcucaugaagaucaccgcggaguggcuguggaaggagcugggcaagaagaagaccccgcgcaugugcacccgggaggaguucacgcgcaaggugcggagcaacgccgcccucggggccaucuucaccgacgagaacaaguggaaguccgcccgcgaggcggucgaggacagcggcuucugggagcugguggacaaggagcggaaccugcaccucgaggggaagugcgagaccugcguguacaacaugaugggcaagcgcgagaagaagcugggggaguucggcaaggccaagggcucccgggccaucugguacauguggcugggggcccgcuuccucgaguucgaggcgcugggcuuccugaacgaggaccacugguucagccgggagaacagccucuccggggucgagggcgaggggcugcacaagcugggcuacauccuccgcgacgugagcaagaaggagggcggggccauguacgccgacgacaccgccggcugggacacgcggaucacccuggaggaccugaagaacgaggagauggugaccaaccacauggagggggagcacaagaagcucgccgaggcgaucuucaagcugaccuaccagaacaaggucgugcgcgugcagcggcccacgccccgcggcaccgucauggacaucaucucccggcgcgaccagcgggggagcggccagguggugaccuacggccugaacaccuucacgaacauggaggcccagcucauccgccagauggagggggagggcgucuucaaguccauccagcagcugaccgugaccgaggagaucgccgugaagaacuggcugguccgcguggggcgggagcgccucagccggauggccaucuccggcgacgacugcguggucaagccccuggacgaccgcuucgccagcgcgcugaccgcccucaacgacaugggcaaggugcggaaggacauccagcagugggagccgucccgcggguggaacgacuggacccaggugcccuucugcagccaccacuuccacgagcugaucaugaaggacggccggguccugguggugcccugccgcaaccaggacgagcucaucgggcgggcccgcaucucccagggcgccggguggagccugcgggagaccgccugccugggcaaguccuacgcgcagauguggaaccucauguacuuccaccgccgggaccugcgccuggccgccaacgccaucugcagcgccguccccucccacugggugccgaccagccggaccaccugguccauccacgcgacgcacgaguggaugaccaccgaggacaugcucaccguguggaaccgcgucuggauccaggagaaccccuggauggaggacaagacgcccguggagagcugggaggagauccccuaccugggcaagcgggaggaccaguggugcgggagccugaucggccucaccucccgcgccaccugggccaagaacauccagaccgccaucaaccaggugcggagccugaucgggaacgaggaguacacggacuacaugccguccaugaagcgcuuccgccgggaggaggaggaggcgggcguccugugguga

SEQ ID NO: 9630 - RNA, 9876 nt, Artificial Sequence
  derived and/or modified CDS sequence (opt1) from DENV-2__JQ045670__SS-prME
agcgccggcaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccgccauggccgacgacaucgggaugggcgugaccuaccuggcgcugcucgccgccuucaaggugcgccccacguucgccgccggccugcugcuccggaagcugaccuccaaggagcugaugaugaccaccaucgggaucguccuccugagccaguccacgauccccgagaccgugcuggagcucaccgacgcgcuggcccugggcaugauggugcucaagaucguccgcaacauggagaaguaccagcuggccgugaccaucauggccauccugugcgucccgaacgccgugauccuccagaacgcguggaaggugagcugcacgauccuggccgucguguccgugagcccccugcuccugaccuccagccagcagaagaccgacuggaucccccuggcccucaccaucaaggggcugaaccccacggccaucuuccugaccacccucucccgcaccaacaagaagcggagcuggccgcugaacgaggcgaucauggccgucggcaugguguccauccuggccagcucccuccugaagaacgacauccccaugacgggcccccugguggccgggggccuccugaccgucugcuacgugcugaccgggcgcagcgccgaccucgagcuggagcgggcgaccgacgugaagugggaggaccaggccgagaucuccggcagcagccccauccuguccaucacgaucagcgaggacggguccaugagcaucaagaacgaggaggaggagcagacccucaccauccugauccgcaccggccugcucgucaucuccggccuguucccgaucagcauccccaucacggccgccgccugguaccugugggaggugaagaagcagcgggcgggggugcucugggacguccccagcccgccgcccaugggcaaggccgagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggcggacgugaagaaggaccugaucagcuacggcgggggcuggaagcuggagggcgaguggaaggagggggaggaggugcagguccucgcccuggagcccggcaagaacccccgggccgugcagaccaagcccgggcuguucaagacgaacaccggcaccaucggggccgugucccucgacuucagccccggcaccuccggcagccccaucaucgacaagaaggggaaggucgugggccuguacgggaacggcguggucacgcgcuccggcgccuacgugagcgcgaucgcccagaccgagaaguccaucgaggacaaccccgagaucgaggacgacaucuuccggaagcgccggcugaccaucauggaccugcaccccggggccggcaagaccaagcgcuaccuccccgccaucgugcgggaggcgaucaagcgcgggcugcggacgcugauccucgccccgacccgcgucguggccgccgagauggaggaggcccugcggggccugcccauccgcuaccagacccccgcgauccgggccgagcacaccgggcgcgagaucguggaccucaugugccacgccacguucaccaugcgccugcugagccccguccgggugccgaacuacaaccucaucaucauggacgaggcccacuucaccgaccccgccuccaucgcggcccgcggcuacaucagcacccggguggagaugggcgaggccgccgggaucuucaugacggccacgccgcccggcagccgcgacccguucccccaguccaacgcgcccaucauggacgaggagcgggagauccccgagcgcagcuggaacuccgggcacgagugggucaccgacuucaagggcaagaccgugugguucgugccgagcaucaaggccgggaacgacaucgccgccugccugcggaagaacggcaagaaggucauccagcugucccgcaagacguucgacagcgaguacgugaagacccggaccaacgacugggacuucguggucaccacggacaucuccgagaugggcgcgaacuucaaggccgagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcgcacuggaaggaggccaagaugcuccuggacaacaucaacacccccgagggcaucaucccgagcauguucgagcccgagcgcgagaagguggacgccaucgacggcgaguaccggcugcgcggggaggcccgcaagacguucgucgaccucaugcggcgcggcgaccugcccguguggcuggccuacaagguggcggccgaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgcggccggccgcaagagccugacccucaaccugaucaccgagaugggccggcugcccacguucaugacccagaagacccgcgacgcccucgacaaccuggccguccugcacaccgcggaggccgggggccgggccuacaaccacgcccucuccgagcugcccgagacgcuggagacccuccugcugcucacccugcuggccaccgugaccggcgggaucuuccucuuccugaugagcgggcgcgggaucggcaagaugacccuggggaugugcugcaucaucaccgcguccauccuccugugguacgcccagauccagccgcacuggaucgccgccagcaucauccuggaguucuuccucaucgugcugcugauccccgagcccgagaagcagcggacgccccaggacaaccagcucaccuacgucgugaucgccauccugacgguggucgcggccaccauggccaacgagaugggcuuccuggagaagaccaagaaggacuucgggcucggcuccaucgccacccagcagccggagagcaacauccuggacaucgaccugcgccccgccuccgcguggacgcucuacgccguggccaccaccuucgugacccccaugcugcggcacagcaucgagaacagcuccgucaacgugagccugacggccaucgccaaccaggcgaccgugcucaugggccuggggaagggcuggccccuguccaagauggacaucggggucccgcuccuggccaucggcugcuacagccaggugaaccccaucacccugaccgccgcccuccugcugcucguggcgcacuacgccaucaucgggcccggccugcaggccaaggccacgcgcgaggcccagaagcgggcggccgccggcaucaugaagaaccccaccgucgacgggaucaccgugaucgaccuggacccgauccccuacgaccccaaguucgagaagcagcucggccaggugaugcugcugauccucugcgucacccaggugcugaugaugcgcacgaccugggcccugugcgaggcccucacccuggcgaccgggcccaucuccacgcugugggagggcaacccggggcgguucuggaacaccaccaucgccgugagcauggccaacaucuuccgcggcuccuaccucgccggcgccgggcugcuguucagcaucaugaagaacaccacgaacacccggcgcggcaccgggaacaucggcgagacccucggcgagaaguggaagucccgccugaacgcgcuggggaaguccgaguuccagacguacaagaaguccggcauccaggaggucgaccggacccucgccaaggaggggaucaagcgcggcgagaccgaccaccacgccgugagccggggguccgccaagcugcgcugguucguggagcggaaccuggucacccccgagggcaaggugguggaccucggcugcgggcgcggcggguggagcuacuacugcggcgggcugaagaacguccgggaggugaagggccugacgaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgaccguggaggcgggccggacgcugcgcguccugaaccucguggagaacuggcugaacaacaacacccaguucugcaucaaggugcugaaccccuacaugcccuccgucaucgagaagauggaggcccugcagcggaaguacggcggggcccucgugcgcaacgaccugagccggaacagcacccacgagauguacuggguguccaacgccagcggcaacaucgucuccagcgugaacaugaucucccgcaugcugaucaaccgguucaccaugcgccacaagaaggccaccuacgagccggacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggcguaccacggcuccuacgagaccaagcagacggggagcgccuccagcauggucaacggcguggugcggcugcucaccaagcccugggacguccugccgaccgugacccagauggccaugacggacaccacccccuucgggcagcagcgcguguucaaggagaaggucgacacccgcacgcaggagcccaaggagggcaccaagaagcugaugaagaucaccgccgaguggcucuggaaggagcugggcaagaagaagacgccccggaugugcacgcgcgaggaguucacccggaaggugcgcuccaacgccgcgcugggggccaucuucaccgacgagaacaaguggaaguccgcccgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggcgaucugguacauguggcugggcgcccgcuuccuggaguucgaggcccucggguuccugaacgaggaccacugguucucccgggagaacagccuguccggcgucgagggggagggccuccacaagcugggguacauccugcgcgacgugagcaagaaggagggcggcgccauguacgcggacgacacggccgggugggacacccggaucacccucgaggaccugaagaacgaggagauggugaccaaccacauggagggcgagcacaagaagcuggccgaggccaucuucaagcucacguaccagaacaaggucgugcgcgugcagcggccgacgccccgggggaccgucauggacaucaucagccggcgcgaccagcggggcuccggccagguggggaccuacggccugaacacguucaccaacauggaggcccagcugauccgccagauggagggggagggcguguucaagaacauccagcaccucaccgucaccgaggagguggcggugcagaacuggcuggcccgggucgggcgcgagcgccugagccggauggccaucuccggcgacgacugcguggugaagccccucgacgaccgcuucgccaacgcccugacggcgcugaacgacaugggcaagauccggaaggacauccagcagugggagcccagcaagggguggaacgacuggacccaggucccguucugcucccaccacuuccacgagcucaucaugaaggacggccgcgugcuggugguccccugccggaaccaggacgagcugaucgggcgcgcccggaucagccagggcgccggguggucccuccgcgagaccgccugccugggcaagagcuacgcccagauguggucccugauguacuuccaccggcgcgaccuccggcuggcggccaacgccaucugcagcgccgugcccucccacugggugcccaccagccgcacgaccugguccauccacgccaagcacgaguggaugaccaccgaggacaugcugaccgucuggaaccggguguggauccgcgagaacccguggauggaggacaagacgcccguggagagcugggaggagauccccuaccucggcaagcgggaggaccaguggugcgggucccugaucggccugaccagccgcgcgaccugggccaagaacauccaggccgccaucaaccagguccggucccucaucgggaacgaggaguacaccgacuacaugcccagcaugaagcgcuuccggcgcgaggaggaggaggcgggcgugcugugguga

SEQ ID NO: 9631 - RNA, 9876 nt, Artificial Sequence
  derived and/or modified CDS sequence (opt1) from DENV-2__JQ045686__SS-prME
agcgcggggaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgucauccuggcguacaccaucgggaccacccacuuccagcgcgugcucaucuucauccugcugacggccguggcccccuccaugaccaugcggugcaucggcaucagcaaccgcgacuucgucgagggcguguccgggggcagcuggguggacaucguccucgagcacggguccugcgugaccaccauggccaagaacaagcccacgcuggacuucgagcugaucaagaccgaggcgaagcagcccgccacccuccggaaguacugcaucgaggccaagcugaccaacacgaccaccgagagccgcugccccacccagggcgagcccucccugaaggaggagcaggacaagcgguucgugugcaagcacagcauggucgaccgcggcugggggaacggcugcggccuguucggcaagggcgggaucgugacgugcgccauguucacgugcaagaagaacauggagggcaagaucgugcagcccgagaaccuggaguacaccaucgucgugacgccccacuccggggaggagcacgccgugggcaacgacacggggaagcacggccaggagaucaaggucaccccgcagagcuccaucaccgaggcggagcugaccggguacggcaccgugacgauggagugcagcccccggaccggccucgacuucaacgagauggugcugcugcagauggagaacaaggccuggcucguccaccgccagugguuccuggaccugccccuccccuggcugccgggggccgacaagcaggaguccaacuggauccagaaggagacccuggugaccuucaagaacccccacgccaagaagcaggacgucguggugcucggcagccaggagggggccaugcacacggcgcugaccggcgccaccgagauccagaugagcuccgggaaccuccuguucaccggccaccugaagugccggcugcgcauggacaagcuccagcugaagggcaugagcuacuccaugugcacggggaaguucaaggucgugaaggagaucgccgagacccagcacggcaccaucgugauccggguccaguacgagggggacggcagccccugcaagauccccuucgagaucauggaccuggagaagcgcuacgugcucggccggcugaucaccgugaacccgaucgucacggagaaggacucccccgugaacaucgaggccgagccgcccuucggggacagcuacaucaucaucggcguggagccggggcagcugaagcucaacugguucaagaagggcuccagcaucgggcagauguucgagaccaccaugcgcggcgccaagcgcauggcgauccugggcgacaccgccugggacuucgggucccugggcggggucuucacgagcaucggcaaggcccuccaccagguguucggggccaucuacggcgccgcguucuccggcgugagcuggaccaugaagauccugaucggggucaucaucaccuggaucggcaugaacucccggagcaccucccugagcgugucccuggugcucgucgggaucgugacgcuguaccugggcgugaugguccaggccgacagcgggugcgugguguccuggaagaacaaggagcucaagugcggcagcggcaucuucaucaccgacaacguccacaccuggaccgagcaguacaaguuccagcccgagagccccuccaagcuggccagcgccauccagaaggcgcaggaggaggggaucugcggcauccgcuccgugacgcggcuggagaaccucauguggaagcagaucacccccgagcugaaccacauccuggccgagaacgaggugaagcucaccaucaucaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggccgagugcccgaacaccaaccgcgcguggaacagccuggaggucgaggacuacggguucggcguguucaccaccaacaucuggcucaagcugaaggagaagcaggacgccuucugcgacuccaagcugaugagcgccgccaucaaggacaaccgggccgugcacgcggacaugggguacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgccggccccgugagccagcacaacuaccgcccgggguaccacacccagaucgccggccccuggcaccuggggaagcuggagauggacuucaacuucugcgacggcaccaccgucaucgugacggaggacugcgggaaccggggccccucccuccgcaccaccaccgcgagcggcaagcugaucacggaguggugcugccggagcugcacccugcccccgcuccgcuaccgcggggaggacggcugcugguacgggauggagauccgcccccugaaggagaaggaggagaaccuggugaacucccucgucaccgccggccacggccagguggacaacuucagccugggcgugcugggcauggcccucuuccuggaggagaugcugcggacccgcgucgggacgaagcacgccauccuccugguggcgguguccuucgucacccugaucaccggcaacaugagcuucaaggaccucgggcgggugguggucauggugggcgccaccaugacggacgacaucgggaugggcgugaccuaccuggcccugcucgccgccuucaagguccgccccaccuucgcggccggccugcugcuccggaagcugaccuccaaggagcugaugaugacgaccaucgggaucgugcuccugagccaguccaccauccccgagaccgugcuggagcucacggacgcccuggcccugggcaugaugguccucaagaucgugcgcaacauggagaaguaccagcuggccgucaccaucauggcgauccugugcgugccgaacgccgugauccuccagaacgccuggaaggucagcugcaccauccuggccgugguguccgucagcccccugcuccugaccuccagccagcagaagacggacuggaucccccuggcccucaccaucaaggggcugaaccccaccgcgaucuuccugaccacgcucucccgcaccaacaagaagcggagcuggccgcugaacgaggccaucauggccgugggcaugguguccauccuggccagcucccuccugaagaacgacauccccaugaccggcccccuggucgccggcgggcuccugaccgugugcuacgugcugacggggcgcagcgccgaccucgagcuggagcgggccaccgacgucaagugggaggaccaggccgagaucuccgggagcagccccauccuguccaucaccaucagcgaggacggguccaugagcaucaagaacgaggaggaggagcagacccucacgauccugauccgcaccggccugcucgugaucuccggccuguucccgaucagcauccccaucaccgccgcggccugguaccugugggaggugaagaagcagcgggccgggguccucugggacgugcccagcccgccgcccaugggcaaggccgagcuggaggacggggccuaccgcaucaagcagaagggcauccugggguacagccagaucggcgcgggcguguacaaggaggggaccuuccacaccauguggcacgucacgcggggcgccgugcucaugcacaaggggaagcgcaucgagcccuccugggccgacgugaagaaggaccugaucagcuacggcgggggcuggaagcuggagggcgaguggaaggagggggaggagguccaggugcucgcccuggagcccggcaagaacccccgggccgugcagaccaagcccgggcuguucaagaccaacaccggcacgaucggggcggucucccucgacuucagccccggcaccuccggcagccccaucaucgacaagaaggggaagguggugggccuguacgggaacggcgucgugacccgcuccggcgccuacgugagcgccaucgcccagaccgagaaguccaucgaggacaaccccgagaucgaggacgacaucuuccggaagcgccggcugacgaucauggaccugcaccccggggccggcaagaccaagcgcuaccuccccgcgaucguccgggaggccaucaagcgcgggcugcggacccugauccucgccccgacccgcgugguggccgcggagauggaggaggcccugcggggccugcccauccgcuaccagacgcccgccauccgggccgagcacaccgggcgcgagaucgucgaccucaugugccacgccaccuucaccaugcgccugcugagccccgugcgggugccgaacuacaaccucaucaucauggacgaggcgcacuucacggaccccgccuccaucgccgcccgcggcuacaucagcacccgggucgagaugggcgaggccgcggggaucuucaugaccgccacgccgcccggcagccgcgacccguucccccaguccaacgcccccaucaucgacgaggagcgggagauccccgagcgcagcuggaacuccgggcacgagugggugacggacuucaagggcaagaccgugugguucgucccgagcaucaaggccgggaacgacaucgccgcgugccugcggaagaacggcaagaaggugauccagcugucccgcaagaccuucgacagcgaguacgugaagacccggacgaacgacugggacuucgucgugaccaccgacaucuccgagaugggcgccaacuucaaggccgagcgcgugaucgacccccggcgcugcaugaagcccgucauccucaccgacggggaggagcgggugauccuggccggccccaugccggugacgcacagcuccgcggcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaaggucgacgccaucgugggcgaguaccggcugcgcggggaggcgcgcaagaccuucguggaccucaugcggcgcggcgaccugcccgucuggcuggccuacaagguggccgccgaggggaucaacuacgccgaccggcgcuggugcuucgacggcaucaagaacaaccagauccucgaggagaacauggaggucgagaucuggaccaaggagggggagcggaagaagcugaagccgcgcuggcuggacgcgcggaucuacuccgacccccucgcccugaaggaguucaaggaguucgccgccggccgcaagagccugacgcucaaccugaucaccgagaugggccggcugcccaccuucaugacccagaagacgcgcgacgcccucgacaaccuggcggugcugcacaccgccgaggccgggggccgggccuacaaccacgcgcucuccgagcugcccgagacccuggagacccuccugcugcucacgcugcuggccaccgugaccgggggcaucuuccucuuccugaugagcggccgcgggaucggcaagaugacccuggggaugugcugcaucaucaccgccuccauccuccugugguacgcccagauccagccgcacuggaucgccgcgagcaucauccuggaguucuuccucaucguccugcugauccccgagcccgagaagcagcggacgccccaggacaaccagcucaccuacguggugaucgccauccugaccgucguggccgccaccauggccaacgagaugggcuuccuggagaagacgaagaaggaccucgggcugggcuccaucgcgacccagcagccggagagcaacauccuggacaucgaccuccgccccgccuccgccuggacccuguacgccguggccaccacguucgucacccccaugcugcggcacagcaucgagaacagcuccgugaacgugagccucaccgcgaucgccaaccaggccaccguccugaugggccuggggaagggcuggccccucuccaagauggacaucggggugccgcugcuggccaucggcugcuacagccaggugaaccccaucacgcucaccgccgcgcugcugcuccuggucgcccacuacgccaucaucgggcccggccugcaggccaaggcgacccgcgaggcccagaagcgggccgccgccggcaucaugaagaaccccaccguggacgggaucacggugaucgaccucgacccgauccccuacgaccccaaguucgagaagcagcugggccaggucaugcugcucgugcugugcgugacccagguccugaugaugcgcaccaccugggcgcucugcgaggcccugacgcuggccaccgggcccaucuccacccucugggagggcaacccggggcgguucuggaacaccacgaucgccgugagcauggccaacaucuuccgcggcuccuaccuggcgggcgccgggcuccucuucagcaucaugaagaacaccaccaacacccggcgcggcacggggaacaugggcgagacccugggcgagaaguggaagucccgccugaacgcccucgggaaguccgaguuccagaucuacaagaaguccggcauccaggagguggaccggacccuggccaaggaggggaucaagcgcggcgagaccgaccaccacgccgucagccggggguccgcgaagcugcgcugguucguggagcggaacauggugacgcccgagggcaaggucguggaccucggcugcgggcgcggcggguggagcuacuacugcggcgggcugaagaacgugcgggaggucaagggccugaccaagggcgggcccggccacgaggagcccaucccgauguccaccuacggguggaaccucgugcgccugcagagcggcguggacgucuucuucaucccgcccgagaagugcgacacccugcucugcgacaucggggaguccagccccaacccgacgguggaggccggccggacccugcgcgugcugaaccucgucgagaacuggcugaacaacaacacccaguucugcaucaaggugcugaaccccuacaugcccuccgugaucgagaagauggaggcccugcagcggaaguacggcggggcccucguccgcaacccgcugagccggaacagcacccacgagauguacuggguguccaacgcgagcggcaacaucguguccagcgucaacaugaucucccgcaugcugaucaaccgguucaccaugcgccacaagaaggccacguacgagcccgacguggaccucgggagcggcacccggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgucgugcggcugcucaccaagccgugggacgugcugcccaccgucacgcagauggccaugaccgacaccacccccuucgggcagcagcgcguguucaaggagaagguggacacgcgcacccaggagcccaaggagggcaccaagaagcugaugaagaucaccgcggaguggcucuggaaggagcugggcaagaagaagacgccgcggaugugcacccgcgaggaguucacccggaagguccgcuccaacgccgcccugggggccaucuucaccgacgagaacaaguggaaguccgcccgggaggcgguggaggacucccgcuucugggagcucgucgacaaggagcggaaccugcaccuggagggcaagugcgagacgugcguguacaacaugauggggaagcgcgagaagaagcucggcgaguucgggaaggccaagggcagccgggccaucugguacauguggcugggcgcccgcuuccuggaguucgaggcccucggguuccugaacgaggaccacugguucucccgggagaacagccuguccggcguggagggggagggccuccacaagcugggguacauccugcgcgacgucagcaagaaggagggcggcgcgauguacgccgacgacaccgccgggugggacacccgggugacccucgaggaccugaagaacgaggagauggugacgaaccacauggagggcgagcacaagaagcuggccgaggcgaucuucaagcucaccuaccagaacaaggucgugcgcgugcagcggcccacgccccgggggaccgucauggacaucaucagccggcgcgaccagcggggcuccggccagguggggacguacggccugaacaccuucaccaacauggaggcccagcugauccgccagauggagggggagggcguguucaagaacauccagcaccucaccgucacggaggagguggccgugaagaacuggcuggcccgggucgggcgcgagcgccugagccggauggccaucuccggcgacgacugcguggugaagccccucgacgaccgcuucgcgaacgcccugaccgcccugaacgacaugggcaagauccggaaggacauccagcagugggagccgagccgcggguggaacgacuggacccagguccccuucugcucccaccacuuccacgagcucaucaugaaggacggccgggugcuggugguccccugccgcaaccaggacgagcugaucgggcgggcccgcaucagccagggcgccggguggucccuccgggagaccgcgugccugggcaagagcuacgcccagauguggucccugauguacuuccaccgccgggaccuccgccuggccgccaacgccaucugcagcgcggugcccucccacugggugccgacgagccggaccaccugguccauccacgccaagcacgaguggaugaccaccgaggacaugcugacggucuggaaccgcguguggauccgggagaaccccuggauggaggacaagacccccguggagagcugggaggagauccccuaccucggcaagcgcgaggaccaguggugcgggucccugaucggccugaccagccgggccaccugggccaagaacauccaggccgcgaucaaccagguccgcucccucaucgggaacgaggaguacacggacuacaugccgagcaugaagcgguuccgccgcgaggaggaggaggccggcgugcugugguga

SEQ ID NO: 9632 - RNA, 9876 nt, Artificial Sequence
  derived and/or modified CDS sequence (opt1) from DENV-2__KU094070__SS-prME
accgccggcaugaucaucaugcugauccccaccgugauggccuuccaccucaccacccggaacggggagccccacaugaucgugagccggcaggagaagggcaagagccugcuguucaagaccgaggacggggugaacaugugcacccucauggcgauggaccugggcgaguggcuggaggacaagaucaccuacaagugcccccuccugcggcagaacgagcccgaggacaucgacugcuggugcaacagcaccuccaccugggugaccuacgggaccugcaccaccaccggcgagcaccggcgcgagaagcggagcgucgcccuggugccccacgugggcauggggcucgagacccgcaccgagaccuggauguccagcgagggcgccuggaagcacgcccagcggaucgagaccuggauccugcgccaccccggguucacgaucauggccgcgauccuggccuacaccaucggcaccacccacuuccagcgggcccucaucuucauccugcugacggccgucgcgcccuccaugaccaugcgcugcaucgggaucagcaaccgggacuucguggagggcguguccggcgggagcugggucgacaucgugcucgagcacggcuccugcgugaccaccauggccaagaacaagcccacgcuggacuucgagcugaucaagaccgaggccaagcagcccgccacccuccgcaaguacugcaucgaggccaagcugaccaacacgaccaccgagagccggugcccgacccagggggagcccucccugaacgaggagcaggacaagcgcuucgucugcaagcacagcaugguggaccggggcuggggcaacgggugcggccucuucgggaagggcuccaucgugacgugcgcgauguucacgugcaagaagaucaugaaggggaaggucgugcagcccgagaaccuggaguacaccaucgugaucacgccccacagcggcgaggagcacgccgucggcaacgacacggggaagcacggcaaggagaucaagaucaccccgcaguccagcaucaccgaggccgagcugaccggguacggcaccgugacgauggagugcagcccccggaccgggcucgacuucaacgagauggugcugcugcagauggagaacaaggccuggcucguccaccggcagugguuccuggaccugccccuccccuggcugccgggcgccgacacccagggcagcaacuggauccagaaggagacccuggugacguucaagaacccccacgcgaagaagcaggacguggucgugcucgggagccaggagggcgccaugcacaccgcccugaccggggccaccgagauccagauguccagcggcuaccugcuguucacggggcaccugaagugccgccugcggauggacaagcuccagcugaagggcauguccuacagcaugugcaccggcaaguucaaggucgugaaggagaucgccgagacccagcacgggaccaucgugauccgcguccaguacgagggcgacgggucccccugcaagauccccuucgagaucauggaccuggagaagcggcacgugcucggccgccugaucacggugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagaccaccaugcgcggggccaagcggauggccauccugggcgacacggccugggacuucggcagccucggcggggucuucaccuccaucgggaaggcccuccaccagguguucggggcgaucuacggggccgccuucagcggcguguccuggaccaugaagauccugaccggcgucaucaucacguggaucgggaugaacagccgcuccaccagccuguccgugagccuggugcucgucggcgccgugacccuguaccugggggugaugguccaggcggacuccggcugcguggugagcuggaagaacaaggagcucaagugcgggagcggcaucuucaucaccgacaacguccacacguggaccgagcaguacaaguuccagcccgagucccccagcaagcuggccuccgccauccagaaggcccacgaggagggcaucugcgggauccggagcgugacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccugggggaaggcgaagaugcucagcacggagucccacaaccagaccuuccugaucgacggccccgagaccgccgagugcccgaacaccaaccgggccuggaacagccuggaggucgaggacuacggcuucgggguguucacgaccaacaucuggcucaagcugcgcgaggagcaggacguguucugcgacuccaagcugaugagcgccgccaucaaggacaaccgggcgguccacgccgacaugggcuacuggaucgaguccgcccucaacgacaccuggaagaucgagaaggccagcuucaucgaggugaaguccugccacuggcccaagagccacacccugugguccaacggggugcuggagagcgagaugaucauccccaagaacuucgccggccccgucagccagcacaacuaccgcccgggcuaccacacccagacggcggggcccuggcaccucggcaagcuggagauggacuucgacuucugcgaggggaccaccgugguggucaccgaggacugcggcaaccgggggcccucccugcgcacgaccaccgccagcggcaagcucaucaccgaguggugcugccgguccugcacgcugcccccgcugcgcuaccggggcgaggacgggugcugguacggcauggagauccgcccccucaaggagaaggaggagaaccuggugaacagccuggugaccgccgggcacggccagaucgacaacuucucccucgggguccugggcauggcccuguuccucgaggagaugcugcggacccgcgugggcaccaagcacgcgauccugcucguggccgucagcuucgugacgcugaucaccgggaacauguccuuccgggaccugggccgcgugauggucauggugggggccaccaugaccgacgacaucggcaugggggugacguaccucgcccugcuggccgcguucaagguccgccccaccuucgccgccggccuccugcugcggaagcucaccagcaaggagcugaugaugaccacgaucggcaucgugcugcucucccagagcaccauccccgagaccauccuggagcugaccgacgcccucgcccuggggaugauggugcugaagaugguccgcaagauggagaaguaccagcucgcggugacgaucauggccauccugugcgugccgaacgccgucauccugcagaacgccuggaagguguccugcaccauccucgccgucgugagcgugagcccccuguuccugaccagcucccagcagaaggcggacuggaucccccucgcccugaccaucaagggccugaaccccacggccaucuuccucaccacccugagccggaccaacaagaagcgcuccuggccgcugaacgaggccaucauggcggucgggauggugagcauccucgccuccagccugcugaagaacgacauccccaugacgggcccccucguggccggcgggcugcugaccgucugcuacgugcucaccggccggagcgccgaccuggagcuggagcgcgccgcggacgugaagugggaggaccaggccgagaucuccgggagcucccccauccucagcaucaccaucuccgaggacggcagcauguccaucaagaacgaggaggaggagcagacgcugaccauccugauccggaccgggcuccuggucaucagcggccuguucccgguguccauccccaucaccgccgccgccugguaccucugggaggugaagaagcagcgcgcgggcguccugugggacgugcccuccccgccgcccguggggaaggccgagcuggaggacggcgccuaccggaucaagcagaaggggauccucggcuacucccagaucggggccggcgucuacaaggagggcaccuuccacacgauguggcacgugacccgcggggccgugcugaugcacaagggcaagcggaucgagcccagcugggcggacgucaagaaggaccugaucuccuacgggggcggguggaagcucgagggcgaguggaaggagggcgaggagguccaggugcuggcccuggagcccgggaagaacccccgcgccguccagaccaagcccggccucuucaagaccaacgccgggacgaucggcgccgugagccuggacuucucccccgggaccagcggcucccccaucaucgacaagaagggcaagguggucgggcuguacggcaacgggguggugacccggagcggcgcguacgucuccgccaucgcccagaccgagaaguccaucgaggacaaccccgagaucgaggacgacaucuuccgcaagcggaagcucacgaucauggaccugcaccccggcgccgggaagaccaagcgcuaccugcccgcgaucgugcgggaggccaucaagcgcggccugcggacccucauccuggccccgacccgcguggucgccgccgagauggaggaggcgcugcgggggcuccccauccgcuaccagacgcccgccauccgcgccgagcacaccggccgggagaucguggaccugaugugccacgccaccuucaccaugcgccugcucagccccgugcgggucccgaacuacaaccugaucaucauggacgaggcccacuucacggaccccgcguccaucgccgcccgcggguacaucagcacccggguggagaugggcgaggccgccggcaucuucaugaccgcgacgccgcccgggucccgcgacccguucccccagagcaacgcccccaucauggacgaggagcgggagauccccgagcgcuccuggagcuccggccacgagugggugacggacuucaaggggaagaccgucugguucgugccgagcaucaaggccggcaacgacaucgccgcgugccugcggaagaacgggaagaaggugauccagcucucccgcaagaccuucgacagcgaguacgucaagacccggacgaacgacugggacuucguggugaccaccgacaucuccgagaugggcgccaacuucaaggccgagcgcgucaucgacccccggcgcugcaugaagcccgugauccugaccgacggcgaggagcgggugacgcuggccgggcccaugccggucacccacagcuccgccgcgcagcgccggggccgcaucgggcggaaccccaagaacgagaacgaccaguacaucuacaugggcgagccccucgagaacgacgaggacugcgcccacuggaaggaggccaagaugcugcuggacaacaucaacacccccgaggggaucaucccgagcauguucgagcccgagcgcgagaagguggacgccaucgacggcgaguaccgccuccggggcgaggcccgcaagaccuucguggaccugaugcggcgcggggaccugcccgucuggcucgcguaccggguggccgccgagggcaucaacuacgccgaccgccgguggugcuucgacgggaucaagaacaaccagauccuggaggagaacguggaggucgagaucuggacgaaggagggcgagcgcaagaagcugaagccgcgguggcucgacgcccgcaucuacuccgacccccuggcgcugaaggaguucaaggaguucgccgccgggcgcaagagccucacccugaaccugaucaccgagaugggccgccuccccaccuucaugacgcagaaggcccgggacgcgcuggacaaccuggccgugcuccacaccgccgaggccggcgggcgcgccuacaaccacgcgcuguccgagcugcccgagacccucgagacccugcugcuccugacgcugcucgccaccgucaccggcgggaucuuccuguuccugaugagcggccggggcaucgggaagaugacccucggcaugugcugcaucaucaccgccuccauccugcugugguacgcccagauccagccgcacuggaucgccgcgagcaucauccucgaguucuuccugaucgugcugcucauccccgagcccgagaagcagcgcacgccccaggacaaccagcugaccuacguggucaucgccauccugaccgugguggccgccaccauggccaacgagaugggguuccucgagaagacgaagaaggaccugggccuggggagcaucaccacccagcagccggaguccaacauccucgacaucgaccugcggcccgcgagcgccuggacccuguacgccgucgccacgaccuucgugacccccaugcuccgccacuccaucgagaacagcuccgugaacgucagccugaccgccaucgcgaaccaggccacggugcugaugggccucggcaagggguggccccuguccaagauggacaucggcgugccgcugcucgccaucgggugcuacagccaggucaaccccaucacccugaccgccgcgcuguuccuccugguggcccacuacgccaucaucggccccgggcugcaggccaaggccacccgggaggcgcagaagcgcgccgccgccggcaucaugaagaaccccacgguggacggcaucaccgucaucgaccucgacccgauccccuacgaccccaaguucgagaagcagcugggccaggugaugcugcucgugcugugcgucacccaggugcugaugaugcggaccacgugggcccucugcgaggcgcugacccuggccaccggccccaucuccacccucugggaggggaacccgggccgcuucuggaacacgaccaucgccgugagcauggccaacaucuuccgcggguccuaccuggccggcgcgggccuccuguucagcaucaugaagaacaccaccaacacgcggcgcgggaccggcaacaucggggagacccugggcgagaaguggaagucccggcugaacgcccucggcaagagcgaguuccagaucuacaagaaguccgggauccaggaggucgaccgcacccuggccaaggagggcaucaagcgcggggagacggaccaccacgccgugagccgcggcuccgcgaagcugcggugguucguggagcgcaaccucgucacccccgaggggaaggugguggaccugggcugcggccgcggcggguggagcuacuacugcggcgggcugaagaacguccgcgaggugaaggggcucaccaagggcgggcccgggcacgaggagcccaucccgauguccaccuacggcuggaaccuggugcggcugcagagcggggucgacguguucuucacgccgcccgagaagugcgacacccuccugugcgacaucggcgagagcucccccaacccgaccguggaggccgggcgcacccugcggguccucaaccugguggagaacuggcugaacaacaacacccaguucugcaucaaggugcucaaccccuacaugcccagcgucaucgagaagauggaggcccugcagcgcaaguacggcggcgcccuggugcggaacccgcugucccgcaacagcacgcacgagauguacuggguguccaacgccagcgggaacaucgucuccagcgugaacaugaucucccggaugcucaucaaccgcuucaccaugcggcacaagaaggcgaccuacgagcccgacguggaccugggcagcgggacccgcaacaucggcaucgaguccgagauccccaaccuggacaucaucgggaagcgcaucgagaagaucaagcaggagcacgagacgagcuggcacuacgaccaggaccaccccuacaagaccugggccuaccacggcuccuacgagaccaagcagaccggcagcgccuccagcauggucaacgggguggugcggcuccugacgaagccgugggacgucgugcccauggugacccagauggccaugaccgacaccacgcccuucggccagcagcgcgucuucaaggagaagguggacacccggacccaggagcccaaggaggggaccaagaagcugaugaagaucacggccgaguggcucuggaaggagcugggcaagaagaagaccccgcgcaugugcacccgggaggaguucacccgcaaggugcgguccaacgcggcccugggcgccaucuucacggacgagaacaaguggaaguccgcccgcgaggccgucgaggacucccgguucugggagcucguggacaaggagcgcaaccugcaccuggaggggaagugcgagaccugcgucuacaacaugaugggcaagcgggagaagaagcucggggaguucggcaaggcgaaggggagccgcgccaucugguacauguggcugggcgcccgguuccuggaguucgaggcccucggcuuccugaacgaggaccacugguucagccgcgagaacucccugagcgggguggagggcgaggggcuccacaagcugggcuacauccugcgggacguguccaagaaggagggcggggcgauguacgccgacgacaccgccggcugggacacccgcaucacgcucgaggaccugaagaacgaggagauggucaccaaccacauggagggggagcacaagaagcuggccgaggccaucuucaagcucaccuaccagaacaagguggugcggguccagcgccccacgccccggggcacggugauggacaucaucagccgccgggaccagcgcggguccggccagguggggaccuacggccugaacaccuucaccaacauggaggcgcagcugauccgccagauggagggcgagggggucuucaagagcauccagcaccucacggugaccgaggagaucgccgugcagaacuggcuggcccgggucggccgcgagcggcugucccgcauggccaucagcggggacgacugcguggugaagccccucgacgaccgguucgccuccgcgcugaccgcccugaacgacaugggcaagguccgcaaggacauccagcagugggagccgagccggggcuggaacgacuggacccaggugcccuucugcucccaccacuuccacgagcucaucaugaaggacgggcgcgugcuggucgugcccugccggaaccaggacgagcugaucggccgcgcccggaucagccagggggccggcuggucccuccgcgagacggccugccugggcaagagcuacgcgcagauguggucccugauguacuuccaccggcgcgaccuccggcuggccgccaacgccaucugcagcgccgugcccucccacugggucccgaccagccgcaccaccuggagcauccacgcgaagcacgaguggaugaccacggaggacaugcugaccguguggaaccggguguggauccaggagaaccccuggauggaggacaagacccccgucgaguccugggaggagauccccuaccucggcaagcgcgaggaccaguggugcggcagccugaucgggcugaccucccgggugacguggggcaagaacauccagaccgccaucaaccaggugcgcagccucaucgggaacgaggaguacaccgacuacaugccguccaugaagcgcuuccggcgcgaggaggaggaggccggcguccugugguga

SEQ ID NO: 9633 - RNA, 9876 nt, Artificial Sequence
  derived and/or modified CDS sequence (opt1) from DENV-2__FM210215__SS-prME
agcgcggggaugaucgugaugcugauccccaccgugauggccuuccaccucaccacccgcaacggggagccccacaugaucgugggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggucaccuacgggaccugcaccaccaccggcgagcaccgccgggagaagcgcagcguggcccuggugccccacgucgggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcgugcucaucuucauccugcugacggccguggcccccuccaugaccaugcggugcaucggcaucagcaaccgcgacuucgucgagggcguguccgggggcagcuggguggacaucguccucgagcacggguccugcgugaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcauggucgaccgcggcugggggaacggcugcggccuguucggcaagggcgggaucgugacgugcgccauguucacgugcaagaagaacauggagggcaagaucgugcagcccgagaaccuggaguacaccaucgucgugacgccccacuccggggaggagcacgcggugggcaacgacacggggaagcacggcaaggagaucaaggucaccccgcagagcuccaucaccgaggccgagcugaccggguacggcaccgugacgauggagugcagcccccggaccggccucgacuucaacgagauggugcugcugcagauggagaacaaggccuggcucguccaccgccagugguuccuggaccugccccuccccuggcugccgggggccgacaagcaggaguccaacuggauccagaaggagacccuggugaccuucaagaacccccacgccaagaagcaggacgucguggugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaaggucgugaaggagaucgccgagacccagcacggcaccaucgugauccggguccaguacgagggggacggcagccccugcaagauccccuucgagaucauggaccuggagaagcgcuacgugcucggccggcugaucaccgugaacccgaucgucacggagaaggacucccccgugaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcggggucuucacgagcaucggcaaggcccuccaccagguguucggggccaucuacggcgcggccuucuccggcgugagcuggaccaugaagauccugaucggggucaucaucaccuggaucggcaugaacucccggagcaccucccugagcgugucccuggugcucgucgggaucgugacgcuguaccugggcgugaugguccaggccgacagcgggugcgugguguccuggaagaacaaggagcucaagugcggcagcggcaucuucaucaccgacaacguccacaccuggaccgagcaguacaaguuccagcccgagagccccuccaagcuggccagcgcgauccagaaggcccaggaggaggggaucugcggcauccgcuccgugacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggaggucgaggacuacggguucggcguguucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggucaagaacugccacuggcccaagucccacacccuguggagcaacggcgugcuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgucaucgugacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgucaccgccggccacggccagguggacaacuucagccugggcgugcugggcauggcccucuuccuggaggagaugcugcggacccgcgucgggacgaagcacgcgauccuccugguggccguguccuucgucacccugaucaccggcaacaugagcuucaaggaccucgggcgggugguggucauggugggcgccaccauggccgacgacaucgggaugggcgugacguaccuggcccugcucgcggccuucaagguccgccccaccuucgccgccggccugcugcuccggaagcugaccuccaaggagcugaugaugaccacgaucgggaucgugcuccugagccaguccaccauccccgagaccgugcuggagcucaccgacgcccuggcgcugggcaugaugguccucaagaucgugcgcaacauggagaaguaccagcuggccgucacgaucauggccauccugugcgugccgaacgccgugguccuccagaacgccuggaaggugagcugcaccauccuggcgguggucuccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcauggucuccauccuggccagcucccuccugaagaacgacauccccaugaccggcccccugguggccgggggccuccugaccgugugcuacguccugaccgggcgcagcgccgaccucgagcuggagaaggccacggacgugaagugggaggaccaggcggagaucuccggcagcagccccauccuguccaucaccaucagcgaggacggguccaugagcaucaagaacgaggaggaggagcagacccucaccauccugauccggacgggccugcucgugaucuccggccuguucccgaucagcauccccaucaccgccgccgccugguaccugugggaggucaagaagcagcgcgccggggugcucugggacgugcccagcccgccgcccaugggcaaggcggagcuggaggacggggccuaccggaucaagcagaagggcauccugggguacagccagaucggcgccggcgucuacaaggaggggaccuuccacaccauguggcacgugacccgcggcgccgugcucaugcacaaggggaagcggaucgagcccuccugggccgacgucaagaaggaccugaucagcuacggcgggggcuggaagcuggagggcgaguggaaggagggggaggagguccaggugcucgcgcuggagcccggcaagaacccccgcgccguccagacgaagcccgggcuguucaagaccaacaccggcaccaucggggccgugucccucgacuucagccccggcacguccggcagccccaucaucgacaagaaggggaagguggucggccuguacgggaacggcguggugacccgguccggcgccuacgucagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccggguggucgccgccgagauggaggaggcccugcgcggccugcccauccgguaccagacccccgccaucaaggcggagcacacggggcgcgagaucguggaccucaugugccacgccaccuucaccaugcggcugcugagccccgugcgcgucccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggugaccgacuucaagggcaagacggucugguucgugccgagcaucaaggcggggaacgacaucgccgccugccugcggaagaacggcaagaaggugauccagcugucccgcaagaccuucgacagcgaguacgucaagacccggaccaacgacugggacuucguggugacgaccgacaucuccgagaugggcgccaacuucaaggcggagcgcgucaucgacccccggcgcugcaugaagcccgugauccucaccgacggggaggagcgggugauccuggccggccccaugccggucacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccggaagaccuucguggaccucaugcgccgcggcgaccugcccgucuggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccgugcugcacacggccgaggccggcgggcgggccuacaaccacgcccucuccgagcugcccgagacccuggagacccuccugcugcucacccugcuggccacggucaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacguggucaucgccauccugaccgugguggccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcggucgccaccaccuucgugacgcccaugcugcggcacagcaucgagaacagcuccgugaacgucagccucaccgccaucgccaaccaggccaccgugcugaugggccuggggaagggcuggccccucuccaagauggacaucggggugccgcugcuggcgaucggcugcuacagccaggucaaccccaucacccucacggccgcccugcugcuccugguggcccacuacgcgaucaucgggcccggccugcaggccaaggccacccgcgaggcccagaagcgggccgcggccggcaucaugaagaaccccaccguggacgggaucaccgucaucgaccucgacccgauccccuacgaccccaaguucgagaagcagcugggccaggugaugcugcucauccugugcgugacgcagguccugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccuguucagcaucaugaagaacacgaccaacacccggcgcggcaccgggaacaucggcgagacgcugggcgagaaguggaagucccggcugaacagccucgggaaguccgaguuccagaucuacaagaaguccggcauccaggagguggaccgcacccuggccaaggaggggaucaagcgcggcgagaccgaccaccacgcggucucccgggggagcgccaagcugcgcugguucguggagcggaacauggugacccccgagggcaaggucguggaccucggcugcgggcgcggcgggugguccuacuacugcggcgggcucaagagcgugcgggaggucaagggccugacgaagggcgggcccggccacgaggagcccaucccgauguccaccuacggguggaaccucgugcgccugcagagcggcguggacgucuucuucaucccgcccgagaagugcgacacccugcucugcgacaucggggaguccagccccaacccgaccguggaggccggccggacgcugcgcgugcugaaccucgucgagaacuggcugaacaacaacacccaguucugcaucaaggugcugaaccccuacaugcccagcgugaucgagaagauggaggcccugcagcggaaguacggcggggcgcucguccgcaacccgcugucccggaacagcacccacgagauguacuggguguccaacgccagcggcaacaucguguccagcgucaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcggcugcucaccaagccgugggacgugcugcccaccgucacccagauggcgaugacggacaccacccccuucgggcagcagcgcguguucaaggagaagguggacacccggacgcaggagcccaaggagggcaccaagaagcugaugaagaucaccgccgaguggcucuggaaggagcugggcaagaagaagaccccgcgcaugugcacgcgcgaggaguucacccggaagguccgcuccaacgccgcccugggggccaucuucaccgacgagaacaaguggaaguccgcgcgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcccgcuuccuggaguucgaggcgcucggguuccugaacgaggaccacugguucucccgggagaacagccugagcggcguggagggggagggccuccacaagcugggguacauccugcgcgacgucuccaagaaggagggcggcgccauguacgccgacgacacggccgggugggacacccggaucacccucgaggaccugaagaacgaggagauggugaccaaccacauggagggcgagcacaagaagcuggcggaggccaucuucaagcucacguaccagaacaaggugguccgcgugcagcggcccacgccccgggggaccgugauggacaucaucagccggcgcgaccagcggggcuccgggcaggucggcaccuacggccugaacacguucaccaacauggaggcccagcugauccgccagauggagggggagggcguguucaagaacauccagcaccucaccgugaccgaggaggucgccgugcagaacuggcuggcccggguggggcgcgagcggcugagccgcauggcgaucuccggcgacgacugcgucgugaagccccucgacgaccgcuucgccaacgcccugacggcccugaacgacaugggcaagauccggaaggacauccagcagugggagccgagcaagggguggaacgacuggacccaggugcccuucugcucccaccacuuccacgagcucaucaugaaggacggccgcguccugguggugcccugccggaaccaggacgagcugaucgggcgcgcccggaucagccagggcgcgggguggucccuccgcgagaccgccugccugggcaagagcuacgcccagauguggucccugauguacuuccaccggcgcgaccuccggcuggccgccaacgcgaucugcagcgccguccccucccacugggugccgaccagccgcacgaccugguccauccacgccaagcacgaguggaugaccaccgaggacaugcugaccguguggaaccgggucuggauccgcgagaaccccuggauggaggacaagacgcccguggagagcugggaggagauccccuaccucggcaagcgggaggaccaguggugcgggucccugaucggccugaccagccgcgccaccugggccaagaacauccaggcggccaucaaccaggugcggagccucaucgggaacgaggaguacaccgacuacaugccguccaugaagcgcuuccggcgcgaggaggaggaggccggcguccugugguga

SEQ ID NO: 9634 - RNA, 9876 nt, Artificial Sequence
  derived and/or modified CDS sequence (opt1) from DENV-2__FM210216__SS-prME
agcgccgggaugaucaucaugcugauccccaccgugauggccuuccaccucaccacccgcaacggggagccccacaugaucgucggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacgaccgagugcccgaacaccaaccgcgcguggaacagccuggagguggaggacuacggguucggcgucuucaccacgaacaucuggcucaagcugaaggagaagcaggacgccuucugcgacuccaagcugaugagcgccgccaucaaggacaaccgggccgugcacgcggacaugggguacuggaucgaguccgcccucaacgacaccuggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgccggccccuggcaccuggggaagcuggagauggacuucgacuucugcgacggcaccacggugaucgucaccgaggacugcgggaaccggggccccucccuccgcaccaccacggcgagcggcaagcugaucaccgaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacgcgcguggggaccaagcacgccauccuccuggucgcgguguccuucgugacccugaucaccggcaacaugagcuucaaggaccucgggcgggucguggugauggucggcgccacgauggccgacgacaucgggaugggcgugaccuaccuggcccugcucgccgcguucaaggugcgccccaccuucgccgccggccugcugcuccggaagcugaccuccaaggagcugaugaugacgaccaucgggaucguccuccugagccaguccaccauccccgagaccgugcuggagcucacggacgcccuggcccugggcaugauggugcucaagaucguccgcaacauggagaaguaccagcuggcggugaccaucauggccauccugugcgucccgaacgccgugauccuccagaacgccuggaaggugagcugcaccauccuggccgucguguccgugagcccccugcuccugaccuccagccagcagaagacggacuggaucccccuggcgcucaccaucaaggggcugaaccccaccgccaucuuccugaccacgcucucccgcaccaacaagaagcggagcuggccgcugaacgaggccaucauggccgucggcaugguguccauccuggcgagcucccuccugaagaacgacauccccaugaccggcccccugguggccgggggccuccugaccgucugcuacgugcugacggggcgcagcgccgaccucgagcuggagcgggccaccgacgugaagugggaggaccaggccgagaucuccggcagcagccccauccuguccaucaccaucagcgaggacggguccaugagcaucaagaacgaggaggaggagcagacccucacgauccugauccgcaccggccugcucgucaucuccggccuguucccgaucagcauccccaucaccgcggccgccugguaccugugggaggugaagaagcagcgggccggggugcucugggacguccccagcccgccgcccaugggcaaggccgagcuggaggacggggcguaccgcaucaagcagaagggcauccugggguacagccagaucggcgccggcguguacaaggaggggaccuuccacaccauguggcacgugacgcggggcgccguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggcggugcagaccaagcccgggcuguucaagaccaacaccggcacgaucggggccgugucccucgacuucagccccggcaccuccggcagccccaucaucgacaagaaggggaaggucgugggccuguacgggaacggcguggucacccgcuccggcgccuacgugagcgccaucgcccagaccgagaaguccaucgaggacaaccccgagaucgaggacgacaucuuccggaagcgccggcugacgaucauggaccugcaccccggggcgggcaagaccaagcgcuaccuccccgccaucgugcgggaggccaucaagcgcgggcugcggacccugauccucgccccgacccgcgucguggcggccgagauggaggaggcccugcggggccugcccauccgcuaccagacgcccgccauccgggccgagcacaccgggcgcgagaucguggaccucaugugccacgcgaccuucaccaugcgccugcugagccccguccgggugccgaacuacaaccucaucaucauggacgaggcccacuucacggaccccgccuccaucgccgcccgcggcuacaucagcacccggguggagaugggcgaggcggccgggaucuucaugaccgccacgccgcccggcagccgcgacccguucccccaguccaacgcccccaucaucgacgaggagcgggagauccccgagcgcagcuggaacuccgggcacgagugggucacggacuucaagggcaagaccgugugguucgugccgagcaucaaggccgggaacgacaucgcggccugccugcggaagaacggcaagaaggucauccagcugucccgcaagaccuucgacagcgaguacgugaagacccggacgaacgacugggacuucguggucaccaccgacaucuccgagaugggcgccaacuucaaggccgagcgcgugaucgacccccggcgcugcaugaagcccgugauccucaccgacggggaggagcgggucauccuggcgggccccaugccggugacgcacagcuccgccgcccagcgccgggggcgcaucggccggaaccccaagaacgagaacgaccaguacaucuacaugggggagccccuggagaacgacgaggacugcgcccacuggaaggaggccaagaugcuccuggacaacaucaacacccccgagggcaucaucccgagcauguucgagcccgagcgcgagaagguggacgcgaucgacggcgaguaccggcugcgcggggaggcccgcaagaccuucgucgaccucaugcggcgcggcgaccugcccguguggcuggccuacaagguggccgccgaggggaucaacuacgcggaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgccggccgcaagagccugacgcucaaccugaucaccgagaugggccggcugcccaccuucaugacccagaagacgcgcgacgcgcucgacaaccuggccguccugcacaccgccgaggccgggggccgggcguacaaccacgcccucuccgagcugcccgagacccuggagacccuccugcugcucacgcugcuggccaccgugaccgggggcaucuuccucuuccugaugagcggccgcgggaucggcaagaugacccuggggaugugcugcaucaucaccgccuccauccuccugugguacgcccagauccagccgcacuggaucgcggccagcaucauccuggaguucuuccucaucgugcugcugauccccgagcccgagaagcagcggacgccccaggacaaccagcucaccuacgucgugaucgccauccugaccguggucgccgccaccauggcgaacgagaugggcuuccuggagaagacgaagaaggaccucgggcugggcuccaucgccacccagcagccggagagcaacauccuggacaucgaccuccgccccgccuccgccuggacccuguacgccguggcgaccacguucgugacccccaugcugcggcacagcaucgagaacagcuccgucaacgugagccucaccgccaucgccaaccaggccaccgugcugaugggccuggggaagggcuggccccucuccaagauggacaucggggucccgcugcuggccaucggcugcuacagccaggugaaccccaucacgcucaccgcggcccugcugcuccugguggcccacuacgccaucaucgggcccggccugcaggcgaaggccacccgcgaggcccagaagcgggccgccgcgggcaucaugaagaaccccaccgucgacgggaucacggugaucgaccucgacccgauccccuacgaccccaaguucgagaagcagcugggccaggugaugcugcucauccugugcgucacccaggugcugaugaugcgcaccaccugggcccucugcgaggcccugacgcuggccaccgggcccaucuccacccucugggagggcaacccggggcgguucuggaacaccacgaucgccgugagcauggcgaacaucuuccgcggcuccuaccuggccggcgccgggcuccucuucagcaucaugaagaacaccaccaacacccggcgcggcacggggaacaucggcgagacccugggcgagaaguggaagucccgccugaacgcccucgggaaguccgaguuccagaucuacaagaaguccggcauccaggaggucgaccggacccuggccaaggaggggaucaagcgcggcgagaccgaccaccacgcggugagccggggguccgccaagcugcgcugguucguggagcggaacauggucacgcccgagggcaaggugguggaccucggcugcgggcgcggcggguggagcuacuacugcggcgggcugaagaacguccgggaggugaagggccugaccaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgacgguggaggccggccggacccugcgcguccugaaccucguggagaacuggcugaacaacaacacccaguucugcaucaaggugcugaaccccuacaugcccuccgucaucgagaagauggaggcccugcagcggaaguacggcggggcgcucgugcgcaacccgcugagccggaacagcacccacgagauguacuggguguccaacgccagcggcaacaucgucuccagcgugaacaugaucucccgcaugcugaucaaccgguucaccaugcgccacaagaaggccacguacgagcccgacguggaccucgggagcggcacccggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggucaacggcguggugcggcugcucaccaagccgugggacguccugcccaccgugacgcagauggcgaugaccgacaccacccccuucgggcagcagcgcguguucaaggagaaggucgacacgcgcacccaggagcccaaggagggcaccaagaagcugaugaagaucaccgccgaguggcucuggaaggagcugggcaagaagaagacgccgcggaugugcacccgcgaggaguucacccggaaggugcgcuccaacgccgcccugggggccaucuucaccgacgagaacaaguggaaguccgcgcgggaggccguggaggacucccgcuucugggagcucgucgacaaggagcggaaccugcaccuggagggcaagugcgagacgugcguguacaacaugauggggaagcgcgagaagaagcucggcgaguucgggaaggccaagggcagccgggccaucugguacauguggcugggcgcccgcuuccuggaguucgaggcgcucggguuccugaacgaggaccacugguucucccgggagaacagccuguccggcgucgagggggagggccuccacaagcugggguacauccugcgcgacgugagcaagaaggagggcggcgccauguacgccgacgacaccgccgggugggacacccggaucacccucgaggaccugaagaacgaggagauggugacgaaccacauggagggcgagcacaagaagcuggcggaggccaucuucaagcucaccuaccagaacaaggucgugcgcgugcagcggcccacgccccgggggaccgucauggacaucaucagccggcgcgaccagcggggcuccggccagguggggacguacggccugaacaccuucaccaacauggaggcccagcugauccgccagauggagggggagggcguguucaagaacauccagcaccucaccgucacggaggagguggccgugcagaacuggcuggcccgggucgggcgcgagcgccugagccggauggcgaucuccggcgacgacugcguggugaagccccucgacgaccgcuucgccaacgcccugaccgcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcccggaucagccagggcgcgggguggucccuccgcgagaccgccugccugggcaagagcuacgcccagauguggucccugauguacuuccaccggcgcgaccuccggcuggccgccaacgcgaucugcagcgccgugcccucccacugggugccgacgagccgcaccaccugguccauccacgccaagcacgaguggaugaccaccgaggacaugcugacggucuggaaccggguguggauccgcgagaaccccuggauggaggacaagacccccguggagagcugggaggagauccccuaccucggcaagcgggaggaccaguggugcgggucccugaucggccugaccagccgcgccaccugggccaagaacauccaggcggccaucaaccagguccggucccucaucgggaacgaggaguacacggacuacaugccgagcaugaagcgcuuccggcgcgaggaggaggaggccggcgugcugugguga

SEQ ID NO: 9635 - RNA, 9876 nt, Artificial Sequence
  derived and/or modified CDS sequence (opt1) from DENV-2__FM210217__SS-prME
accgccggcgugaucaucaugcugauccccaccgccauggcguuccaccucaccacccggaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgaccaccggcgcgagaagcgguccgucgcccuggugccccacguggggaugggccucgagacccggaccgagaccuggaugagcuccgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgacaucaaggggaucaugcaggccggcaagcggucccugcgcccccagcccaccgagcugaaguacagcuggaagaccuggggcaaggccaagaugcucuccaccgagagccacaaccagacguuccugaucgacgggccggagaccgccgagugccccaacaccaaccgggccuggaacucccuggagguggaggacuacggcuucgggguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggucaagagcugccacuggcccaagucccacacccuguggagcaacggcgugcuggaguccgagaugaucauccccaagagcuucgccgggccggugucccagcacaacuaccgccccggcuacuacacccagaccgccgggcccuggcaccucggcaagcuggagauggacuucgacuucugcgaggggacgaccguggucgugaccgaggacugcggcaaccggggccccagccugcgcaccacgaccgccagcgggaagcucaucaccgaguggugcugccgguccugcacccugccgccccugcgcuaccggggcgaggacgggugcugguacggcauggagauccgcccccucaaggagaaggaggagaaccuggugaacagccuggucacggcggggcacggccagaucgacaacuucucccucggcgugcuggggauggcccuguuccucgaggagaugcugcggacccgcgugggcaccaagcacgccauccugcucgucgccgugagcuucgugacccugaucacggggaacauguccuuccgggaccugggccgcgucauggugauggugggggccgcgaugaccgacgacaucggcaucggcgucaccuaccucgcccugcuggccgccuucaaggugcgccccaccuucgccgcggggcuccugcugcggaagcucacgagcaaggagcugaugauggccaccaucggcaucgcccugcucucccagagcaccaucccggagaccauccuggagcugacggacgcccucgcccuggggaugauggugcugaagaucguccgcaacauggagaaguaccagcucgcggugaccaucauggccaucuccugcgugcccaacgccgucauccugcagaacgccuggaaggugagcugcaccauccuggcgaccguguccgucagcccccuccugcugacguccagccagcagaaggccgacuggaucccccucgcccugaccaucaagggccugaacccgaccgccaucuuccucaccacgcugucccggaccagcaagaagcgcuccuggccccugaacgaggccaucauggcggugggcauggucagcauccucgccuccagccugcugaagaacgacauccccaugaccgggccccucguggccggcgggcugcugaccgugugcuacguccucacgggccggagcgccgaccuggagcuggagcgcgccaccgacgugaagugggaggaccaggcggagaucuccgggagcuccccgauccucagcaucaccaucgccgaggacggcuccaugagcaucaagaacgaggaggaggagcagacccugacgauccugauccggaccggccuccuggugaucuccgggcuguuccccgucagcauccccaucaccgccgccgccugguaccucugggaggugaagaagcagcgcgcgggcgugcugugggacguccccuccccgccgcccguggggaaggccgagcuggaggacggcgccuaccggaucaagcagaaggggauccucggcuacagccagaucggcgccgggguguacaaggagggcaccuuccacaccauguggcacgucacgcgcggggccgugcugaugcaccggggcaagcgcaucgagccguccugggcggacgugaagaaggaccugaucagcuacgggggcggcuggaagcucgagggggaguggaaggagggcgaggagguccaggugcuggcccuggagcccgggaagaacccccgggccgugcagaccaagcccggccucuucaagaccaacaccgggacgaucggcgccgucucccuggacuucagcccgggcaccuccgggagccccaucguggaccgcaagggcaagguggucgggcuguacggcaacggcguggugacccgguccggggcguacgucagcgccaucgcccagaccgagaaguccaucgaggacaaccccgagaucgaggacgacaucuuccgcaagaagcggcucacgaucauggaccugcaccccggcgccgggaagaccaagcgcuaccugccggccaucgugcgggaggcgaucaagcgcggccugcggacccucauccuggcccccacccgcguggucgccgccgagauggaggaggcccugcgcgggcuccccauccgguaccagacgcccgcgauccgcgccgagcacaccggccgggagaucguggaccugaugugccacgccaccuucaccaugcgccugcucagcccggugcggguccccaacuacaaccugaucaucauggacgaggcccacuucacggaccccgccagcaucgcggcccgcggcuacaucuccacccggguggagaugggggaggccgccggcaucuucaugaccgcgacgccgcccgggagcaaggaccccuucccccaguccaacgcccccaucauggacgaggagcgcgagauccccgagcggagcuggaacuccggccacgagugggugacggacuucaaggggaagaccgucugguucgugcccagcaucaaggccggcaacgacaucgccgccugccugcgcaagaacggcaagaaggugauccagcucucccggaagaccuucgacagcgaguacgucaagacccgcacgaacgacugggacuucguggugaccaccgacaucuccgagaugggggcgaacuucaaggccgagcgggucaucgacccccgccggugcaugaagcccgugauccugaccgacggcgaggagcgcgugauccuggccgggccgaugcccgucacgcacagcuccgccgcccagcggcgcggccggaucgggcgcaaccccaagaacgagaacgaccaguacaucuacaugggcgagccccucgagaacgacgaggacugcgcgcacuggaaggaggccaagaugcugcuggacaacaucaacaccccggagggcaucauccccagcauguucgagcccgagcgcgagaagguggacgccaucgacggggaguaccggcuccgcggcgaggcccggaagaccuucguggaccugaugcgccgcggggaccugccggucuggcucgccuaccgcguggcggccgagggcaucaacuacgccgaccggcgcuggugcuucgacggggugaagaacaaccagauccuggaggagaacgucgagguggagaucuggaccaaggagggcgagcggaagaagcugaagccccgcuggcucgacgcccggaucuacuccgacccccuggcgcugaaggaguucaaggaguucgccgccggccgcaagagccucacgcugaaccugaucaccgagauggggcggcuccccaccuucaugacccagaaggcccgcgacgcccuggacaaccuggcggugcuccacacggccgaggccggcgggcgggccuacaaccacgcccuguccgagcugccggagacccucgagacccugcugcuccugacccugcucgcgacggucaccggcggcaucuuccuguuccugaugagcgggaagggcguggggaagaugacccucggcaugugcugcaucaucaccgccuccauccugcuguggcacgcccagauccagccccacuggaucgccgccagcaucauccucgaguucuuccugaucguccugcucauccccgagcccgagaagcagcgcaccccgcaggacaaccagcugacguacguggugaucgcgauccugaccgucguggccgccaccauggccaacgagaugggguuccucgagaagaccaagaaggaccugggccugggcuccaucgccacgcaggagcccgagagcaacauccucgacaucgaccugcggcccgcgagcgccuggacccuguacgccguggccaccaccuucgucacgcccaugcuccgccacuccaucgagaacagcuccgugaacgugagccugaccgcgaucgccaaccaggccaccguccugauggggcucggcaagggguggccgcuguccaagauggacaucggcgugccccugcucgccaucgggugcuacagccaggugaaccccaucacccugacggccgcgcugcuccugcuggucgcccacuacgccaucaucggccccggccuccaggccaaggccacccgggaggcgcagaagcgcgccgccgccgggaucaugaagaacccgaccguggacggcaucaccgugaucgaccuggaccccauccccuacgaccccaaguucgagaagcagcuggggcaggucaugcuccugauccugugcgugacccaggugcucaugaugcggaccaccugggcccugugcgaggcgcugacccucgccacgggcccgaucuccacccugugggaggggaaccccggccgcuucuggaacaccaccaucgccgucagcauggccaacaucuuccgcggcuccuaccuggcgggggccggccuccuguucagcaucaugaagaacacgaccaacacccggcgcgggaccggcaacaucggcgagacgcugggggagaaguggaagucccggcucaacgcccugggcaagagcgaguuccagaucuacaagaaguccgggauccaggagguggaccgcacccuggccaaggagggcaucaagcgcggggagaccgaccaccacgccgugagccgcggcuccgcgaagcuccggugguucgucgagcgcaacauggugacccccgagggcaagguggucgaccuggggugcggccgcgggggcuggagcuacuacugcgggggccugaagaacgugcgcgaggugaagggccucacgaagggcggccccgggcacgaggagccgauccccauguccaccuacggcuggaaccugguccggcugcagagcgggguggacguguucuucacgccgcccgagaagugcgacacccuccugugcgacaucggcgaguccagcccgaaccccacgaucgaggccggccgcacccugcggguccucagccugguggagaacuggcugaacaacgacacccaguucugcaucaaggugcucaaccccuacaugccguccgucaucgagaagauggagacccugcagcgcaaguacgggggcgcccuggugcggaacccccugagccgcaacuccacccacgagauguacugggugagcaacgccacggggaacaucgucuccagcgugaacaugaucucccggaugcucaucaaccgcuucaccaugaagcacaagaaggccaccuacgagcccgacguggaccugggcagcgggacccggaacaucggcaucgaguccgagauccccaaccuggacaucaucggcaagcgcaucgagaagaucaagcaggagcacgagacgagcuggcacuacgaccaggaccacccguacaagaccugggcguaccacggguccuacgagaccaagcagaccggcagcgccuccagcauggucaacgggguggugcgccuccugacgaagcccugggacgucgugcccauggugacccagauggccaugaccgacaccacgcccuucggccagcagcgggucuucaaggagaagguggacacccgcacccaggagccgaaggagggcaccaagaagcugaugaagaucacggccgaguggcucuggaaggagcuggggaagaagaagacgccccggaugugcacccgcgaggaguucacccggaaggugcgcuccaacgccgcgcugggcgccaucuucacggacgagaacaaguggaaguccgcccgggaggccgucgaggacucccgcuucugggagcucguggacaaggagcggaaccugcaccuggaggggaagugcgagaccugcguguacaacaugaugggcaagcgcgagaagaagcucggggaguucggcaaggcgaagggcagccgggccaucugguacauguggcugggggcccgcuuccuggaguucgaggcccucggcuuccugaacgaggaccacugguucucccgggagaacagccugagcggggucgagggcgaggggcuccacaagcugggcuacauccugcgcgacguguccaagaaggagggcggggccauguacgcggacgacaccgccggcugggacacccggaucacgcucgaggaccugaagaacgaggagauggucaccaaccacauggagggggagcacaagaagcuggccgaggccaucuucaagcucaccuaccagaacaagguggugcgcguccagcggcccacgccccggggcacggugauggacaucaucagccggcgcgaccagcggggguccggccaggugggcaccuacgggcugaacaccuucaccaacauggaggcccagcugauccgccagauggagggcgaggggaucuucaagagcauccagcaccucacggcgaccgaggagaucgccguccagaacuggcuggcccgcgugggccgggagcgccugucccggauggccaucagcggcgacgacugcguggucaagccgcucgacgaccgcuucgccuccgcgcugaccgcccugaacgacauggggaaggugcggaaggacauccagcagugggagcccagccgcggcuggaacgacuggacccaggugcccuucugcucccaccacuuccacgagcucaucaugaaggacgggcggguccugguggugcccugccgcaaccaggacgagcugaucggccgggcccgcaucagccagggggccggcuggucccucaaggagacggccugccugggcaagagcuacgcgcagauguggucccugauguacuuccaccggcgcgaccuccggcuggccgccaacgccaucugcagcgcggucccgucccacugggugcccaccagccgcaccaccugguccauccacgccaagcacgaguggaugaccacggaggacaugcugaccguguggaaccgggucuggauccaggagaaccccuggauggaggacaagacccccguggagagcugggaggaggugccguaccucgggaagcgcgaggaccaguggugcggcagccugaucgggcugaccucccgggccacgugggccaagaacauccagaccgccaucaaccagguccgcagccucaucggcaacgaggaguacaccgacuacaugcccuccaugaagcgguuccgccgcgaggaggaggaggcgggggugcugugguga

SEQ ID NO: 9636 - RNA, 9876 nt, Artificial Sequence
  derived and/or modified CDS sequence (opt1) from DENV-2__JX286524__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaaguccuucgccgggcccgugagccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccuccgggaagcucaucaccgaguggugcugccggagcugcacccugcccccgcugcgcuaccggggcgaggacgggugcugguacggcauggagauccgcccccucaaggagaaggaggagaaccuggucaacucccuggugaccgccgggcacggccagaucgacaacuucagccucggcgugcuggggauggcccuguuccucgaggagaugcugcggacgcgcgucggcaccaagcacgcgauccugcucguggcccuguccuucgugacccugaucaccgggaacaugagcuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacguccaaggagcugaugauggccaccaucggcaucgcccuccugagccaguccacccugcccgagaccauccucgagcugacggacgcgcuggcccucgggaugauggcccugaagaucgugcgcaacauggagaaguaccagcuggccgucaccaucauggccaucagcugcgugccgaacgcggugauccuccagaacgccuggaaggucuccugcaccauccuggccgccgugagcgugagcccccugcuccugaccagcucccagcagaaggcggacuggaucccccuggcccucacgaucaagggccugaaccccaccgccaucuuccugaccacccucagccggacguccaagaagcgcagcuggccgcugaacgaggccaucauggccgucggcaugguguccauccuggcgagcagccuccugaagaacgacauccccaugaccgggccccuggucgccggcgggcuccugaccgugugcuacgugcugaccggccgguccgccgaccucgagcuggagcgcgccgccgacgucaagugggaggaccaggcggagaucagcggguccagccccauccuguccaucacgaucagcgaggacggcuccaugagcaucaagaacgaggaggaggagcagacccucaccauccugauccggaccggccugcucgugaucuccgggguguucccggucagcauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacagccagaucggcgccgggguguacaaggagggcacguuccacaccauguggcacgucacccgcggggccgugcugaugcaccgcggcaagcggaucgagcccuccugggccgacgugaagaaggaccucaucagcuacgggggcggcuggaagcuggagggggaguggaaggagggcgaggagguccaggugcuggcgcucgagcccgggaagaacccccgcgccgugcagaccaagcccggcaucuucaagacgaacaccgggaccaucggcgccgucucccuggacuucagccccggcaccuccgggagccccaucguggaccggaagggcaagguggucgggcuguacggcaacggcguggugacgcgcuccggggccuacgucagcgcgaucgcccagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggcgccgacccgcguggucgccgccgagauggaggaggcccugcgggggcuccccauccgcuaccagacccccgccauccgggcggagcacaccggccgcgagaucguggaccugaugugccacgccacguucaccaugcggcugcucucccccgugcgcgucccgaacuacaaccugaucaucauggacgaggcccacuucaccgaccccgccagcaucgccgcgcggggcuacaucuccacccgcguggagaugggggaggccgccggcaucuucaugacggccacgccgcccgggagccgggacccguucccccaguccaacgcgcccaucauggacgaggagcgcgagauccccgagcggagcuggaacuccggccacgagugggugaccgacuucaaggggaagaccgucugguucgugccgagcaucaaggccggcaacgacaucgccgccugccugcgcaagaacggcaagaaggugauccagcucucccggaagacguucgacagcgaguacgucaagacccgcgccaacgacugggacuucguggugaccaccgacaucuccgagaugggggcgaacuucaaggccgagcgggucaucgacccccgccggugcaugaagcccgugauccugacggacggcgaggagcgcgugauccuggccgggcccaugccggucacccacagcuccgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccgagcauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggacgaaggagggcgagcggaagaagcugaagccgcgcuggcucgacgcccggaucuacuccgacccccuggcgcugaaggaguucaaggaguucgccgccggccgcaagagccucacccugaaccugaucaccgagauggggcggcuccccaccuucaugacgcagaaggcccgcaacgcccuggacaaccuggcggugcuccacaccgccgaggugggcgggaaggccuacacccacgcccuguccgagcugcccgagacccucgagacgcugcugcuccugacccugcucgccgcggucaccggcggcaucuuccuguuccugaugagcgggaagggcaucgggaagaugacccucggcaugugcugcaucaucaccgccuccauccugcugugguacgcccagauccagccgcacuggaucgccgccagcaucauccucgaguucuuccugaucgugcugcucauccccgagcccgagaagcagcggacgccccaggacaaccagcugaccuacgucgugaucgcgauccugaccguggucgccgccaccauggccaacgagaugggguuccucgagaagacgaagaaggaccugggcuucggcagcaucaccacccaggaguccgagagcaacauccuggacaucgaccuccgcccggccuccgcguggacccuguacgccguggccacgaccuucgugacccccaugcugcggcacagcaucgagaacuccagcgucaacgugucccucaccgccaucgcgaaccaggccacggugcugauggggcugggcaagggguggccccucagcaagauggacaucggcgucccccugcuggccaucgggugcuacucccaggugaacccgaucacccucaccgccgcccugcugcuccugguggcgcacuacgccaucaucggccccggccugcaggccaaggccacccgcgaggcccagaagcgggcggccgccgggaucaugaagaaccccacggucgacggcaucaccgugaucgaccucgagcccaucccguacgaccccaaguucgagaagcagcuggggcaggucaugcugcucauccugugcgucacccaggugcugaugaugcgcaccacgugggcccucugcgaggcccugacccuggcgaccggccccaucagcacccucugggaggggaaccccggccgguucuggaacacgaccaucgccguguccauggccaacaucuuccgcggcagcuaccuggccggggcgggccuccuguucuccaucaugaagaacaccaccaacacgcgccgggggaccggcaacgucggcgagacccugggggagaaguggaagucccgccugaacgcccucggcaaguccgaguuccagaucuacaagaaguccgggauccaggagguggaccggacccuggccaaggagggcaucaagcgcggggagacggaccaccacgccgugucccggggcagcgccaagcugcgcugguucgucgagcggaacauggugaccccggagggcaagguggucgaccucgggugcggccgcgggggcugguccuacuacugcgggggccugaagaacgugcgggaggugaagggccugaccaagggcgggcccgggcacgaggagcccauccccaugagcaccuacggcuggaaccucguccgccugcagagcgggguggacguguucuucacgccgcccgagaagugcgacacccugcucugcgacaucggcgaguccagccccaaccccaccaucgaggcgggccggacccugcgcguccugaaccucguggagaacuggcugaacaacaacacccaguucugcaucaaggugcugaacccguacaugcccuccgucaucgagaagauggagacgcuccagcggaaguacgggggcgcccuggugcgcaacccccugagccggaacuccacccacgagauguacugggugagcaacgccaccgggaacaucgucuccagcgugaacaugaucucccgcaugcugaucaaccgguucaccaugaagcacaagaaggccacguacgagccggacguggaccucggcagcgggacccgcaacaucggcaucgaguccgagauccccaaccuggacaucaucggcaagcggaucgagaagaucaagcaggagcacgagaccagcuggcacuacgaccaggaccaccccuacaagaccugggccuaccacggguccuacgagacgaagcagaccggcagcgcguccagcauggucaacgggguggugcgccugcucaccaagcccugggacgucgugccgauggugacccagauggccaugacggacaccacccccuucggccagcagcgcgucuucaaggagaagguggacacccggacgcaggagcccaaggagggcaccaagaagcugaugaagaucaccgccgaguggcuguggaaggagcucgggaaggagaagacgccccggaugugcacgcgggaggaguucacccgcaaggugcgguccaacgccgcccugggcgcggucuucaccgacgagaacaaguggaaguccgcccgcgaggccguggaggacgggcgguucugggagcugguggaccgcgagcggaaccuccaccuggagggcaagugcgagaccugcgucuacaacaugauggggaagcgcgagaagaagcugggcgaguucggcaaggccaaggggucccgggcgaucugguacauguggcucggcgcccgcuuccuggaguucgaggcccugggguuccucaacgaggaccacugguucagccggggcaacagccuguccgggguggagggcgagggccugcaccgccucggguacauccugcgggaggucggcaagaaggagggcggcgccauguacgccgacgacacggcggggugggacacccgcaucacccuggaggaccucaagaacgaggagauggugaccaaccacaugaagggcgagcacaagaagcuggccgaggccaucuucaagcugacguaccagaacaaggugguccgggugcagcgcccgacgccccggggcaccgugauggacaucaucagccgcaaggaccagcggggguccggccaggucgggaccuacggccucaacacguucaccaacauggaggcccagcugauccgccagauggagggcgaggggaucuucaagagcauccagcaccugaccgccaccgaggagaucgcggugcagaacuggcucgcccgcgugggccgggagcgccugucccggauggccaucagcggggacgacugcgucgugaagcccaucgacgaccgcuucgccuccgcccugacggcgcucaacgacaugggcaaggugcggaaggacauccagcagugggagcccagccgcggguggaacgacuggacccaggucccguucugcucccaccacuuccacgagcuggugaugaaggacggccgggugcuggucgugcccugccgcaaccaggacgagcucaucggccgggcccgcaucagccagggggccggcuggucccugaaggagaccgccugccugggcaagagcuacgcccagauguggacccucauguacuuccaccggcgcgaccugcggcuggcggccaacgccaucugcuccgccgugcccagccacuggguccccaccucccgcacgaccuggagcauccacgcgaagcacgaguggaugaccaccgaggacaugcucgccguguggaaccggguguggauccaggagaacccguggauggaggacaagacgcccgucgaguccugggaggaggugcccuaccugggcaagcgcgaggaccaguggugcgggagccugaucggccucaccagccgggccaccugggccaagaacauccagaccgccaucaaccaggugcgcucccugaucggcaacgagggguacacggacuacaugcccagcaugaagcgguuccgccgcgaggaggaggaggcgggcguccugugguga

SEQ ID NO: 9637 - RNA, 9876 nt, Artificial Sequence
  derived and/or modified CDS sequence (opt1) from DENV-2__JX286520__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaucgugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcgugcaguacgagggcgacggcucccccugcaagauccccuucgagaucaccgaccuggagaagcggcacguccucgggcgccugaucaccgugaacccgaucgugaccgagaaggacagccccgucaacaucgaggcggagccgcccuucggcgacuccuacaucaucguggggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcaucgugagcuggaagaacaaggagcucaagugcggcuccgggaucuucaucacggacaacgugcacaccuggaccgagcaguacaaguuccagcccgagagccccagcaagcuggccuccgccauccagaaggcccacgaggagggcaucugcgggauccggagcgucacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgcgauccugcucguggcccugagcuucgugacccugaucaccgggaacauguccuuccgggaccucggccgcgucauggugauggugggggccaccaugacggacgacaucggcaugggcgucaccuaccuggcccugcucgccgcguucaaggugcgccccaccuucgccgccgggcugcugcuccggaagcugaccagcaaggagcugaugauggccacgaucggcaucgcccuccugucccagagcacccugcccgagaccauccucgagcugaccgacgcgcuggcccucgggaugauggcccugaagaucgugcgcaacauggagaaguaccagcuggccgucacgaucauggccaucuccugcgugccgaacgcggugauccuccagaacgccuggaaggucagcugcaccauccuggccgccguguccgugagcccccugcuccugaccuccagccagcagaaggcggacuggaucccccuggcccucaccaucaagggccugaaccccacggccaucuuccugaccacccucucccggaccagcaagaagcgcuccuggccgcugaacgaggccaucauggccgucggcauggugagcauccuggcguccagccuccugaagaacgacauccccaugacggggccccuggucgccggcgggcuccugaccgugugcuacgugcugaccggccggagcgccgaccucgagcuggagcgcgccgccgacgucaagugggaggaccaggcggagaucuccgggagcucccccauccugagcaucaccaucuccgaggacggcagcauguccaucaagaacgaggaggaggagcagacgcucaccauccugauccggaccggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacucccagaucggcgccgggguguacaaggagggcaccuuccacacgauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcgcucgagcccgggaagaacccccgcgccgugcagaccaagcccggcaucuucaagaccaacacggggaccaucggcgccgucagccuggacuucucccccggcaccagcgggucccccaucguggaccggaagggcaagguggucgggcuguacggcaacggcguggugacccgcagcggggccuacgucuccgcgaucgcccagacggagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacccucauccuggcgccgacgcgcguggucgccgccgagauggaggaggcccugcgggggcuccccauccgcuaccagacccccgccauccgggcggagcacaccggccgcgagaucguggaccugaugugccacgccaccuucacgaugcggcugcucagccccgugcgcgucccgaacuacaaccugaucaucauggacgaggcccacuucaccgaccccgccuccaucgccgcgcggggcuacaucagcacccgcguggagaugggggaggccgccggcaucuucaugaccgccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccugcgcaagaacggcaagaaggugauccagcucagccggaagaccuucgacuccgaguacgucaagacgcgcgccaacgacugggacuucguggugaccaccgacaucagcgagaugggggcgaacuucaaggccgagcgggucaucgacccccgccggugcaugaagcccgugauccugaccgacggcgaggagcgcgugauccuggccgggcccaugccggucacgcacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggaccaaggagggcgagcggaagaagcugaagccgcgcuggcucgacgcccggaucuacagcgacccccuggcgcugaaggaguucaaggaguucgccgccggccgcaagucccucacgcugaaccugaucaccgagauggggcggcuccccaccuucaugacccagaaggcccgcaacgcccuggacaaccuggcggugcuccacacggccgaggugggcgggaaggccuacacccacgcccugagcgagcugcccgagacccucgagacccugcugcuccugacgcugcucgccgcggucaccggcggcaucuuccuguuccugauguccgggaagggcaucgggaagaugacccucggcaugugcugcaucaucaccgccagcauccugcugugguacgcccagauccagccgcacuggaucgccgccuccaucauccucgaguucuuccugaucgugcugcucauccccgagcccgagaagcagcggacgccccaggacaaccagcugacguacgucgugaucgcgauccugaccguggucgccgccaccauggccaacgagaugggguuccucgagaagaccaagaaggacuucggcuucggcagcaucacgacccaggagagcgaguccaacauccuggacaucgaccugcgcccggccagcgcguggacccucuacgccguggccaccacguucgugacccccaugcugcggcacuccaucgagaacagcuccgucaacgugagccugaccgccaucgcgaaccaggccaccgugcucauggggcugggcaagggguggccccuguccaagauggacaucggcgucccccuccuggccaucgggugcuacagccaggugaacccgaucacgcugaccgccgcccuccugcugcucguggcgcacuacgccaucaucggccccggccugcaggccaaggccacccgcgaggcccagaagcgggcggccgccgggaucaugaagaaccccaccgucgacggcaucacggugaucgaccuggagcccaucccguacgaccccaaguucgagaagcagcucgggcaggucaugcugcugauccucugcgucacccaggugcugaugaugcgcaccaccugggcccugugcgaggcccucacgcuggcgaccggccccaucuccacccugugggaggggaaccccggccgguucuggaacaccacgaucgccgugagcauggccaacaucuuccgcggcuccuaccucgccggggcgggccugcuguucagcaucaugaagaacaccaccaacacccgccgggggacgggcaacgucggcgagacccucggggagaaguggaagucccgccugaacgcccugggcaagagcgaguuccagaucuacaagaaguccgggauccaggagguggaccggacccucgccaaggagggcaucaagcgcggggagaccgaccaccacgccgugagccggggcuccgccaagcugcgcugguucgucgagcggaacauggugacgccggagggcaagguggucgaccuggggugcggccgcgggggcuggagcuacuacugcgggggccucaagaacgugcgggaggugaagggccugaccaagggcggccccgggcacgaggagcccauccccauguccaccuacggcuggaaccugguccgccuccagagcgggguggacguguucuucaccccgcccgagaagugcgacacgcugcugugcgacaucggcgagagcucccccaaccccaccaucgaggcgggccggacccuccgcguccugaaccugguggagaacuggcucaacaacaacacccaguucugcaucaaggugcugaacccguacaugcccagcgucaucgagaagauggagacccugcagcggaaguacgggggcgcccucgugcgcaacccccugucccggaacagcacgcacgagauguacuggguguccaacgccaccgggaacaucgucagcuccgugaacaugaucagccgcaugcugaucaaccgguucaccaugaagcacaagaaggccaccuacgagccggacguggaccugggcuccgggacgcgcaacaucggcaucgagagcgagauccccaaccucgacaucaucggcaagcggaucgagaagaucaagcaggagcacgagaccuccuggcacuacgaccaggaccaccccuacaagaccugggccuaccacgggagcuacgagaccaagcagacgggcuccgcgagcuccauggucaacgggguggugcgccugcugaccaagcccugggacgucgugccgauggugacccagauggccaugaccgacacgacccccuucggccagcagcgcgucuucaaggagaagguggacacccggacccaggagcccaaggagggcacgaagaagcucaugaagaucaccgccgaguggcuguggaaggagcuggggaaggagaagacgccccggaugugcacccgggaggaguucacgcgcaaggugcggagcaacgccgcccucggcgcggucuucaccgacgagaacaaguggaaguccgcccgcgaggccguggaggacgggcgguucugggagcugguggaccgcgagcggaaccugcaccucgagggcaagugcgagaccugcgucuacaacaugauggggaagcgcgagaagaagcugggcgaguucggcaaggccaaggggagccgggcgaucugguacauguggcugggcgcccgcuuccucgaguucgaggcccugggguuccugaacgaggaccacugguucucccggggcaacagccucagcgggguggagggcgagggccugcaccgccugggguacauccuccgggaggucggcaagaaggagggcggcgccauguacgccgacgacaccgcggggugggacacgcgcaucacccuggaggaccugaagaacgaggagauggugaccaaccacaugaagggcgagcacaagaagcucgccgaggccaucuucaagcugaccuaccagaacaaggugguccgggugcagcgcccgacgccccggggcaccgugauggacaucaucucccgcaaggaccagcgggggagcggccaggucgggaccuacggccugaacaccuucacgaacauggaggcccagcucauccgccagauggagggcgaggggaucuucaaguccauccagcaccugaccgccaccgaggagaucgcggugcagaacuggcuggcccgcgugggccgggagcgccucagccggauggccaucuccggggacgacugcgucgugaagcccaucgacgaccgcuucgccagcgcccugaccgcgcugaacgacaugggcaaggugcggaaggacauccagcagugggagcccucccgcggguggaacgacuggacgcaggucccguucugcagccaccacuuccacgagcucgugaugaaggacggccgggugcuggucgugcccugccgcaaccaggacgagcugaucggccgggcccgcaucucccagggggccggcuggagccucaaggagaccgccugccuggggaaguccuacgcccagauguggacccugauguacuuccaccggcgcgaccuccggcuggcggccaacgccaucugcagcgccgugcccucccacuggguccccaccagccgcaccacgugguccauccacgcgaagcacgaguggaugaccaccgaggacaugcuggccguguggaaccggguguggauccaggagaacccguggauggaggacaagacccccgucgagagcugggaggaggugcccuaccucggcaagcgcgaggaccaguggugcgggucccugaucggccugacgagccgggccaccugggccaagaacauccagaccgccaucaaccaggugcgcagccucaucggcaacgagggguacaccgacuacaugcccuccaugaagcgguuccgccgcgaggaggaggaggcgggcguccugugguga

SEQ ID NO: 9638 - RNA, 9876 nt, Artificial Sequence
  derived and/or modified CDS sequence (opt1) from DENV-2__JX286525__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaaguccuucgccgggcccgugagccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccuccgggaagcucaucaccgaguggugcugccggagcugcacccugcccccgcugcgcuaccggggcgaggacgggugcugguacggcauggagauccgcccccucaaggagaaggaggagaaccuggucaacucccuggugaccgccgggcacggccagaucgacaacuucagccucggcgugcuggggauggcccuguuccucgaggagaugcugcggacgcgcgucggcaccaagcacgcgauccugcucguggcccuguccuucgugacccugaucaccgggaacaugagcuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacguccaaggagcugaugauggccaccaucggcaucgcccuccugagccaguccacccugcccgagaccauccucgagcugacggacgcgcuggcccucgggaugauggcccugaagaucgugcgcaacauggagaaguaccagcuggccgucaccaucauggccaucagcugcgugccgaacgcggugauccuccagaacgccuggaaggucuccugcaccauccuggccgccgugagcgugagcccccugcuccugaccagcucccagcagaaggcggacuggaucccccuggcccucacgaucaagggccugaaccccaccgccaucuuccugaccacccucagccggacguccaagaagcgcagcuggccgcugaacgaggccaucauggccgucggcaugguguccauccuggcgagcagccuccugaagaacgacauccccaugaccgggccccuggucgccggcgggcuccugaccgugugcuacgugcugaccggccgguccgccgaccucgagcuggagcgcgccgccgacgucaagugggaggaccaggcggagaucagcggguccagccccauccuguccaucacgaucagcgaggacggcuccaugagcaucaagaacgaggaggaggagcagacccucaccauccugauccggaccggccugcucgugaucuccgggguguucccggucagcauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacagccagaucggcgccgggguguacaaggagggcacguuccacaccauguggcacgucacccgcggggccgugcugaugcaccgcggcaagcggaucgagcccuccugggccgacgugaagaaggaccucaucagcuacgggggcggcuggaagcuggagggggaguggaaggagggcgaggagguccaggugcuggcgcucgagcccgggaagaacccccgcgccgugcagaccaagcccggcaucuucaagacgaacaccgggaccaucggcgccgucucccuggacuucagccccggcaccuccgggagccccaucguggaccggaagggcaagguggucgggcuguacggcaacggcguggugacgcgcuccggggccuacgucagcgcgaucgcccagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggcgccgacccgcguggucgccgccgagauggaggaggcccugcgggggcuccccauccgcuaccagacccccgccauccgggcggagcacaccggccgcgagaucguggaccugaugugccacgccacguucaccaugcggcugcucucccccauccgcgugccgaacuacaaccugaucaucauggacgaggcccacuucaccgaccccgccagcaucgccgcgcggggcuacaucuccacccgcgucgagaugggggaggccgccggcaucuucaugacggccacgccgcccgggagccgggacccguucccccaguccaacgcgcccaucauggacgaggagcgcgagauccccgagcggagcuggaacuccggccacgagugggugaccgacuucaaggggaagaccgugugguucgucccgagcaucaaggccggcaacgacaucgccgccugccugcgcaagaacggcaagaaggugauccagcucucccggaagacguucgacagcgaguacgugaagacccgcgccaacgacugggacuucgucgugaccaccgacaucuccgagaugggggcgaacuucaaggccgagcgggugaucgacccccgccggugcaugaagcccgucauccugacggacggcgaggagcgcgugauccuggccgggcccaugccggugacccacagcuccgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccgagcauguucgagcccgagcgcgagaaggucgacgccaucgacggggaguaccggcuccgcggcgaggcccggaagaccuucguggaccugaugcgccgcggggaccugcccguguggcucgccuacaaggucgcggccgagggcaucaacuacgccgaccgcaaguggugcuucgacgggaucaagaacaaccagauccuggaggagaacguggagguggagaucuggacgaaggagggcgagcggaagaagcugaagccgcgcuggcucgacgcccggaucuacuccgacccccuggcgcugaaggaguucaaggaguucgccgccggccgcaagagccucacccugaaccugaucaccgagauggggcggcuccccaccuucaugacgcagaaggcccgcaacgcccuggacaaccuggcgguccuccacaccgccgaggugggcgggaaggccuacacccacgcccuguccgagcugcccgagacccucgagacgcugcugcuccugacccugcucgccgcggugaccggcggcaucuuccuguuccugaugagcgggaagggcaucgggaagaugacccucggcaugugcugcaucaucaccgccuccauccugcugugguacgcccagauccagccgcacuggaucgccgccagcaucauccucgaguucuuccugaucguccugcucauccccgagcccgagaagcagcggacgccccaggacaaccagcugaccuacguggucaucgcgauccugaccgugguggccgccaccauggccaacgagaugggguuccucgagaagacgaagaaggaccugggcuucggcagcaucaccacccaggaguccgagagcaacauccuggacaucgaccuccgcccggccuccgcguggacccuguacgccgucgccacgaccuucgugacccccaugcugcggcacagcaucgagaacuccagcgugaacgucucccucaccgccaucgcgaaccaggccacggugcugauggggcugggcaagggguggccccucagcaagauggacaucggcgugccccugcuggccaucgggugcuacucccaggucaacccgaucacccucaccgccgcccugcugcuccugguggcgcacuacgccaucaucggccccggccugcaggccaaggccacccgcgaggcccagaagcgggcggccgccgggaucaugaagaaccccacgguggacggcaucaccgucaucgaccucgagcccaucccguacgaccccaaguucgagaagcagcuggggcaggucaugcugcucauccugugcgugacccagguccugaugaugcgcaccacgugggcccucugcgaggcccugacccuggcgaccggccccaucagcacccucugggaggggaaccccggccgguucuggaacacgaccaucgccguguccauggccaacaucuuccgcggcagcuaccuggccggggcgggccuccuguucuccaucaugaagaacaccaccaacacgcgccgggggaccggcaacgugggcgagacccugggggagaaguggaagucccgccugaacgcccucggcaaguccgaguuccagaucuacaagaaguccgggauccaggaggucgaccggacccuggccaaggagggcaucaagcgcggggagacggaccaccacgccgugucccggggcagcgccaagcugcgcugguucguggagcggaacauggucaccccggagggcaaggugguggaccucgggugcggccgcgggggcugguccuacuacugcgggggccugaagaacguccgggaggugaagggccugaccaagggcgggcccgggcacgaggagcccauccccaugagcaccuacggcuggaaccucgugcgccugcagagcggggucgacguguucuucacgccgcccgagaagugcgacacccugcucugcgacaucggcgaguccagccccaaccccaccaucgaggcgggccggacccugcgcgugcugaaccucgucgagaacuggcugaacaacaacacccaguucugcaucaaggugcugaacccguacaugcccuccgugaucgagaagauggagacgcuccagcggaaguacgggggcgcccugguccgcaacccccugagccggaacuccacccacgagauguacugggugagcaacgccaccgggaacaucguguccagcgucaacaugaucucccgcaugcugaucaaccgguucaccaugaagcacaagaaggccacguacgagccggacguggaccucggcagcgggacccgcaacaucggcaucgaguccgagauccccaaccuggacaucaucggcaagcggaucgagaagaucaagcaggagcacgagaccagcuggcacuacgaccaggaccaccccuacaagaccugggccuaccacggguccuacgagacgaagcagaccggcagcgcguccagcauggugaacggggucgugcgccugcucaccaagcccugggacguggucccgauggugacccagauggccaugacggacaccacccccuucggccagcagcgcguguucaaggagaaggucgacacccggacgcaggagcccaaggagggcaccaagaagcugaugaagaucaccgccgaguggcuguggaaggagcucgggaaggagaagacgccccggaugugcacgcgggaggaguucacccgcaaggugcgguccaacgccgcccugggcgcgguguucaccgacgagaacaaguggaaguccgcccgcgaggccgucgaggacgggcgguucugggagcugguggaccgcgagcggaaccuccaccuggagggcaagugcgagaccugcguguacaacaugauggggaagcgcgagaagaagcugggcgaguucggcaaggccaaggggucccgggcgaucugguacauguggcucggcgcccgcuuccuggaguucgaggcccugggguuccucaacgaggaccacugguucagccggggcaacagccuguccggggucgagggcgagggccugcaccgccucggguacauccugcgggaggugggcaagaaggagggcggcgccauguacgccgacgacacggcggggugggacacccgcaucacccuggaggaccucaagaacgaggagauggucaccaaccacaugaagggcgagcacaagaagcuggccgaggccaucuucaagcugacguaccagaacaagguggugcggguccagcgcccgacgccccggggcaccgugauggacaucaucagccgcaaggaccagcggggguccggccagguggggaccuacggccucaacacguucaccaacauggaggcccagcugauccgccagauggagggcgaggggaucuucaagagcauccagcaccugaccgccaccgaggagaucgcgguccagaacuggcucgcccgcgugggccgggagcgccugucccggauggccaucagcggggacgacugcguggucaagcccaucgacgaccgcuucgccuccgcccugacggcgcucaacgacaugggcaaggugcggaaggacauccagcagugggagcccagccgcggguggaacgacuggacccaggugccguucugcucccaccacuuccacgagcuggucaugaaggacggccgggugcuggugguccccugccgcaaccaggacgagcucaucggccgggcccgcaucagccagggggccggcuggucccugaaggagaccgccugccugggcaagagcuacgcccagauguggacccucauguacuuccaccggcgcgaccugcggcuggcggccaacgccaucugcuccgccgugcccagccacugggugcccaccucccgcacgaccuggagcauccacgcgaagcacgaguggaugaccaccgaggacaugcucgccgucuggaaccggguguggauccaggagaacccguggauggaggacaagacgcccguggaguccugggaggagguccccuaccugggcaagcgcgaggaccaguggugcgggagccugaucggccucaccagccgggccaccugggccaagaacauccagaccgccaucaaccaggugcgcucccugaucggcaacgagggguacacggacuacaugcccagcaugaagcgguuccgccgcgaggaggaggaggcgggcgugcugugguga

SEQ ID NO: 9639 - RNA, 9876 nt, Artificial Sequence
  derived and/or modified CDS sequence (opt1) from DENV-2__KM279598__SS-prME
accgcgggcaucaucaucaugaugauccccaccgugauggccuuccaccugaccacccgcaacggggagccccacaugaucgucucccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucaccaucauggcggccauccuggccuacaccaucggcaccaccuacuuccagcggguccugaucuucauccuccugaccgccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggacccugcgcccccagccgaccgagcugaaguacuccuggaaggcguggggcaaggccaagaugcucagcacggagcugcacaaccacaccuuccugaucgacggccccgagaccgccgagugccccaacaccaaccgggccuggaacucccucgagguggaggacuacggguucggcgucuucacgaccaacaucuggcugaagcugaaggagcgccaggacguguucugcgacagcaagcucauguccgccgcgaucaaggacaaccgggccgugcacgccgacaugggguacuggaucgagagcgcccugaacgacaccuggaagaucgagaaggccuccuucaucgaggucaagagcugccacuggccgaagucccacacccuguggagcaacggcgugcucgaguccgagaugaucauccccaagaacuucgcgggccccgugagccagcacaacuaccgccccggguaccacacccagacggccggcccguggcaccuggggcggcuggagauggacuucgacuucugcgagggcaccaccgucguggugaccgaggacugcgggaaccgcggccccucccuccggacgaccaccgccagcggcaagcugaucaccgaguggugcugccgcagcugcacgcugccgccccuccgguaccgcggggaggacggcugcugguacgggauggagauccggccgcugaaggagaaggaggagaaccuggucaacucccucgugaccgccggccacgggcagaucgacaacuucagccugggcgugcugggcauggcccucuuccuggaggagaugcugcgcacccgggucgggaccaagcacgccauccuccugguggccguguccuucgucacgcugaucaccggcaacaugagcuuccgcgacguggggcgcgugauggucauggugggcgccaccaugaccgacgacaucgggaugggcgugacguaccucgcccugcuggcggccuucaagauccggcccaccuucgccgccggccuccugcugcgcaagcucaccuccaaggagcugaugaugaccacgaucgggaucguccugcucagccaguccaccauccccgagagcauccuggagcugaccgacgcccucgcgcugggcaugauggugcugaagaucguccggaacauggagaaguaccagcucgccgugaccaucauggccauccugugcgugcccaacgccgucauccugcagaacgccuggaagguguccugcacgacccucgcgguggucagcguguccccgcugcugcucaccagcucccagcagaaggccgacuggaucccccuggcccugaccaucaaggggcucaaccccacggccaucuuccugaccacccugagccgcaccuccaagaagcggagcuggccccucaacgaggcgaucauggccgugggcauggucuccauccuggccagcucccugcucaagaacgacaucccgaugacgggcccccugguggccgggggccugcucaccgugugcuacguccugaccgggcgcagcgccgaccuggagcucgagcgggcggccgacgugcgcugggaggagcaggccgagaucagcggcuccagccccauccuguccaucaccaucagcgaggacggguccaugagcaucaagaacgaggaggaggagcagacgcugaccauccucauccggaccggccugcuggugaucuccggccucuuccccgucagcaucccgaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacagccagaucggcgccggcguguacaaggaggggaccuuccacacgauguggcacgucacccgcggcgcggugcugaugcacaaggggaagcggaucgagcccuccugggccgacgugaagaaggaccucaucagcuacggcgggggcuggaagcuggagggcgaguggaaggagggggaggagguccaggugcuggcccucgagcccggcaagaacccccgcgccgugcagaccaagcccgggcuguucaagaccaacacgggcaccaucggggccgucucccuggacuucagccccggcaccuccggcagccccaucguggacaagaaggggaagguggucggccucuacgggaacggcguggugacccgguccggcacguacgucagcgcgaucgcccagaccgagaaguccaucgaggacaacccggagaucgaggacgacaucuuccgcaagaagcggcugaccaucauggaccugcaccccggggccggcaagaccaagcgcuaccugcccgccaucgugcgggaggcgaucaagcgcgggcuccggacgcugauccuggcccccacccgcguggucgccgccgagauggaggaggcccuccgcggccugccgauccgguaccagacccccgcgauccgcgccgagcacaccgggcgggagaucguggaccugaugugccacgccacguucaccaugcgccuccugagccccauccgggugcccaacuacaaccugaucaucauggacgaggcccacuucaccgacccggccagcaucgcggcccgcggcuacaucuccacccgggucgagaugggcgaggccgccgggaucuucaugacggccacgccgcccggcagccgcgaccccuucccgcaguccaacgcgcccaucauggacgaggagaaggagauccccgagcggagcuggaacuccgggcacgagugggugaccgacuucaagggcaagaccgugugguucguccccagcaucaaggccgggaacgacaucgccgccugccuccgcaagaacggcaagaaggugauccagcugucccggaagacguucgacagcgaguacaucaagacccgcaccaacgacugggacuucguggucaccacggacaucuccgagaugggcgcgaacuucaaggccgagcgggugaucgacccgcgccggugcaugaagcccgugauccugaccgacggggaggagcgcgucauccucgccggccccaugcccgugacccacagcuccgccgcccagcggcgcgggcgggugggccgcaacccgaagaacgagaacgaccaguacaucuacaugggggagccccuggagaacgacgaggacugcgcgcacuggaaggaggccaagaugcugcucgacaacaucaacacccccgagggcaucauccccagcauguucgagccggagcgcgagaaggucgacgccaucgacggcgaguaccggcugcgcggggaggcccggaagacguucguggaccugaugcgccggggcgaccuccccgucuggcuggccuaccgcguggcggccgaggggaucaacuacgccgaccggcgcuggugcuucgacggcgugaagaacaaccagauccuggaggagaacgucgagguggagaucuggaccaaggagggggagcggaagaagcucaagccccgcuggcuggacgcccggaucuacuccgacccgcuggcccucaaggaguucaaggaguucgcggccggccgcaagagccugacccugaaccucaucaccgagaugggccggcugcccacguucaugacccagaaggccaagaacgcccuggacaaccucgcggugcugcacaccgccgaggccgggggccgcgccuacaaccacgcccuguccgagcuccccgagacccuggagacgcugcuccugcugacccuccuggcgaccgucaccgggggcaucuuccuguuccucaugagcggcaaggggaucggcaagaugacccuggggaugugcugcaucaucacggccuccauccugcucugguacgcccagauccagccccacuggaucgccgccagcaucauccuggaguucuuccugaucgugcuccugaucccggagcccgagaagcagcggacgccccaggacaaccagcugaccuacguggucaucgcgauccucaccgugguggccgccacgauggccaacgagaugggcuuccuggagaagaccaagaaggacuucgggcugggcuccaucaccacccagcagcccgagagcaacauccucgacaucgaccugcgcccggccagcgcguggacgcuguacgccgucgccaccaccuucaucacccccaugcuccggcacuccaucgagaacagcuccgugaacgugagccugacggccaucgccaaccaggcgaccguccugaugggccucgggaagggcuggccccuguccaagauggacaucggggugccccugcucgccaucggcugcuacagccaggugaacccgaucacccugaccgccgcccugcuccugcuggucgcgcacuacgccaucaucgggcccggccuccaggccaaggccacgcgcgaggcccagaagcgggcggccgccggcaucaugaagaaccccaccguggacgggaugaccgugaucgaccuggaccccaucccguacgaccccaaguucgagaagcagcugggccaggucaugcuccuggugcugugcgugacccagguccucaugaugcgcacgaccugggcccugugcgaggcccugacccucgcgaccgggcccaucuccacgcugugggagggcaaccccgggcgguucuggaacaccaccaucgccgugagcauggccaacaucuuccgcggcuccuaccuggccggcgccgggcuccuguucagcaucaugaagaacaccgcgaacacgcgccggggcaccgggaacaccggcgagacccugggcgagaaguggaagaaccgccucaacgcccuggggaaguccgaguuccagaucuacaagaaguccggcauccaggagguggaccggacgcuggccaaggaggggaucaagcgcggcgagaccgaccaccacgccgucagccgggggagcgcgaagcuccgcugguucguggagcggaaccuggugaccccggagggcaaggucguggaccugggcugcgggcgcggcgggugguccuacuacugcggcgggcucaagaacgugaaggaggucaagggccugaccaagggcgggcccggccacgaggagcccauccccaugagcacguacggguggaaccuggugcggcuccaguccggcguggacgucuucuucaccccgcccgagaagugcgacacccugcugugcgacaucggggagagcucccccaaccccaccguggaggccggccgcacccuccgggugcugaaccuggucgagaacuggcucaacaacaacacgcaguucugcaucaaggugcugaacccguacaugcccagcgugaucgagaagauggaggcccugcagcgcaaguacggcggggcccugguccggaacccccucagccgcaacuccacccacgagauguacugggugagcaacgccuccggcaacaucgugagcuccgucaacaugaucagccggaugcugaucaaccgcuucaccaugcggcacaagaaggcgaccuacgagccggacguggaccugggguccggcacgcgcaacaucgggaucgagagcgagacccccaaccucgacaucaucggcaagcggaucgagaagaucaagcaggagcacgagaccuccuggcacuacgaccaggaccaccccuacaagaccugggccuaccacggcagcuacgagacgaagcagaccggguccgccagcuccauggugaacggcgucgugcgccugcugaccaagcccugggacgugaucccgauggucacccagauggccaugacggacaccacccccuucgggcagcagcgcguguucaaggagaaggucgacacccggacgcaggagcccaaggagggcaccaagaagcucaugaagaucaccgccgaguggcuguggaaggagcugggcaagaagaagacgccccgcaugugcacgcgggaggaguucacccgcaaggugcggagcaacgcggcccucggggccaucuucaccgacgagaacaaguggaaguccgcccgcgaggccguggaggacagcggcuucugggagcuggucgacaaggagcggaaccugcaccucgaggggaagugcgagaccugcguguacaacaugaugggcaagcgcgagaagaagcugggggaguucggcaaggcgaagggcucccgggccaucugguacauguggcugggggcccgcuuccucgaguucgaggcccugggcuuccugaacgaggaccacugguucagccgggagaacucccucagcgggguggagggcgaggggcugcacaagcugggcuacauccuccgcgacgucagcaagaaggagggcggggcgauguacgccgacgacacggccggcugggacacccggaucacccuggaggaccugaagaacgaggagauggugaccaaccacauggagggggagcacaagaagcucgccgaggccaucuucaagcugacguaccagaacaaggugguccgcgugcagcggccgacgccccgcggcaccgugauggacaucaucucccggcgcgaccagcgggggagcggccaggucgugaccuacggccugaacaccuucaccaacauggaggcgcagcucauccgccagauggagggggagggcguguucaaguccauccagcagcugaccgucaaggaggagaucgccgugaagaacuggcugauccggguggggcgcgagcgccucagccggauggccaucuccggcgacgacugcgucgugaagccccuggacgaccgcuucgccagcgcccugaccgcgcucaacgacaugggcaaggugcggaaggacauccagcagugggagcccucccgcggguggaacgacuggacgcaggucccguucugcagccaccacuuccacgagcugaucaugaaggacggccgggugcuggugguccccugccgcaaccaggacgagcucaucgggcgggcccgcaucucccagggcgccggguggagccugcgggagaccgccugccugggcaaguccuacgcccagauguggagccucauguacuuccaccgccgggaccugcgccuggcggccaacgccaucugcuccgccgugcccagccacuggauccccaccucccggaccaccuggagcauccacgccacgcacgaguggaugaccaccgaggacaugcucaccguguggaaccgcgucuggauccaggagaacccguggauggaggacaagacgcccguggaguccugggaggagauccccuaccugggcaagcgggaggaccaguggugcgggagccugaucggccucaccagccgcgcgaccugggccaagaacauccagaccgccaucaaccaggugcggucccugaucgggaacgaggaguacacggacuacaugcccagcaugaagcgcuuccggcgcgaggaggaggaggccggcguccugugguga

SEQ ID NO: 9640 - RNA, 9876 nt, Artificial Sequence
  derived and/or modified CDS sequence (opt1) from DENV-2__KM279576__SS-prME
accgcgggcaucaucaucaugaugauccccaccgugauggccuuccaccugaccacccgcaacggggagccccacaugaucgucucccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggacccugcgcccccagccgaccgagcugaaguacuccuggaaggcguggggcaaggccaagaugcucagcacggagcugcacaaccacaccuuccugaucgacggccccgagaccgccgagugccccaacaccaaccgggccuggaacucccucgagguggaggacuacggguucggcgucuucacgaccaacaucuggcugaagcugaaggagcgccaggacguguucugcgacagcaagcucauguccgccgcgaucaaggacaaccgggccgugcacgccgacaugggguacuggaucgagagcgcccugaacgacaccuggaagaucgagaaggccuccuucaucgaggucaagagcugccacuggccgaagucccacacccuguggagcaacggcgugcucgaguccgagaugaucauccccaagaacuucgcgggccccgugagccagcacaacuaccgccccggguaccacacccagacggccggcccguggcaccuggggcggcuggagauggacuucgacuucugcgagggcaccaccgucguggugaccgaggacugcgggaaccgcggccccucccuccggacgaccaccgccagcggcaagcugaucaccgaguggugcugccgcagcugcacgcugccgccccuccgguaccgcggggaggacggcugcugguacgggauggagauccggccgcugaaggagaaggaggagaaccuggucaacucccucgugaccgccggccacgggcagaucgacaacuucagccugggcgugcugggcauggcccucuuccuggaggagaugcugcgcacccgggucgggaccaagcacgccauccuccugguggccguguccuucgucacgcugaucaccggcaacaugagcuuccgcgaccucgggcgcgugauggugauggucggcgccaccaugaccgacgacaucgggaugggcgugacguaccuggcccugcucgcggccuucaagauccggcccaccuucgccgccggccugcugcuccgcaagcugaccuccaaggagcugaugaugaccacgaucgggaucgugcuccugagccaguccaccauccccgagagcauccuggagcucaccgacgcccuggcgcugggcaugaugguccucaagaucgugcggaacauggagaaguaccagcuggccgucaccaucauggccauccugugcgugcccaacgccgugauccuccagaacgccuggaaggucuccugcacgacccuggcgguggugagcgucuccccgcugcuccugaccagcucccagcagaaggccgacuggaucccccuggcccucaccaucaaggggcugaaccccacggccaucuuccugaccacccucagccgcaccuccaagaagcggagcuggccccugaacgaggcgaucauggccgugggcaugguguccauccuggccagcucccuccugaagaacgacaucccgaugacgggcccccuggucgccgggggccuccugaccgugugcuacgugcugaccgggcgcagcgccgaccucgagcuggagcgggcggccgacguccgcugggaggagcaggccgagaucagcggcuccagccccauccuguccaucaccaucagcgaggacggguccaugagcaucaagaacgaggaggaggagcagacgcucaccauccugauccggaccggccugcucgugaucuccggccuguuccccgugagcaucccgaucaccgccgccgcgugguaccugugggaggucaagaagcagcgcgccggggugcucugggacgugcccagcccgccgcccgucggcaaggccgagcuggaggacggggccuaccggaucaagcagaagggcauccugggguacagccagaucggcgccggcguguacaaggaggggaccuuccacacgauguggcacgugacccgcggcgcgguccucaugcacaaggggaagcggaucgagcccuccugggccgacgugaagaaggaccugaucagcuacggcgggggcuggaagcuggagggcgaguggaaggagggggaggaggugcagguccucgcccuggagcccggcaagaacccccgcgccgugcagaccaagcccgggcuguucaagaccaacacgggcaccaucggggccgugucccucgacuucagccccggcaccuccggcagccccaucgucgacaagaaggggaagguggugggccuguacgggaacggcgucgugacccgguccggcacguacgugagcgcgaucgcccagaccgagaaguccaucgaggacaacccggagaucgaggacgacaucuuccgcaagaagcggcugaccaucauggaccugcaccccggggccggcaagaccaagcgcuaccuccccgccaucguccgggaggcgaucaagcgcgggcugcggacgcugauccucgcccccacccgcgugguggccgccgagauggaggaggcccugcgcggccugccgauccgguaccagacccccgcgauccgcgccgagcacaccgggcgggagaucgucgaccucaugugccacgccacguucaccaugcgccugcugagccccauccgggugcccaacuacaaccucaucaucauggacgaggcccacuucaccgacccggccagcaucgcggcccgcggcuacaucuccacccggguggagaugggcgaggccgccgggaucuucaugacggccacgccgcccggcagccgcgaccccuucccgcaguccaacgcgcccaucauggacgaggagaaggagauccccgagcggagcuggaacuccgggcacgagugggucaccgacuucaagggcaagaccgugugguucgugcccagcaucaaggccgggaacgacaucgccgccugccugcgcaagaacggcaagaaggucauccagcugucccggaagacguucgacagcgaguacaucaagacccgcaccaacgacugggacuucguggugaccacggacaucuccgagaugggcgcgaacuucaaggccgagcgggucaucgacccgcgccggugcaugaagcccgugauccucaccgacggggaggagcgcgugauccuggccggccccaugcccgucacccacagcuccgccgcccagcggcgcgggcgggugggccgcaacccgaagaacgagaacgaccaguacaucuacaugggggagccccuggagaacgacgaggacugcgcgcacuggaaggaggccaagaugcuccuggacaacaucaacacccccgagggcaucauccccagcauguucgagccggagcgcgagaagguggacgccaucgacggcgaguaccggcugcgcggggaggcccggaagacguucgucgaccucaugcgccggggcgaccugcccguguggcuggccuaccgcgucgcggccgaggggaucaacuacgccgaccggcgcuggugcuucgacggcgugaagaacaaccagauccucgaggagaacguggaggucgagaucuggaccaaggagggggagcggaagaagcugaagccccgcuggcuggacgcccggaccuacuccgacccgcucgcccugaaggaguucaaggaguucgcggccggccgcaagagccugacccucaaccugaucacggagaugggccggcugcccaccuucaugacccagaaggccaagaacgcccucgacaaccuggcggugcugcacaccgccgaggccgggggccgcgccuacaaccacgcccucuccgagcugcccgagacgcuggagacccuccugcugcucacccugcuggcgaccgugaccgggggcaucuuccucuuccugaugagcggcaaggggaucggcaagaugacgcuggggaugugcugcaucaucaccgccuccauccuccugugguacgcccagauccagccccacuggaucgccgccagcaucauccuggaguucuuccucaucguccugcugaucccggagcccgagaagcagcggacgccccaggacaaccagcucaccuacguggugaucgcgauccugacggucguggccgccaccauggccaacgagaugggcuuccuggagaagaccaagaaggacuucgggcucggcuccaucaccacgcagcagcccgagagcaacauccuggacaucgaccugcgcccggccagcgcguggacccucuacgccguggccaccaccuucaucacgcccaugcugcggcacuccaucgagaacagcuccgucaacgugagccugaccgccaucgccaaccaggcgaccgugcucaugggccuggggaagggcuggccccuguccaagauggacaucggggucccccuccuggccaucggcugcuacagccaggugaacccgaucacccugacggccgcccuccugcugcucguggcgcacuacgccaucaucgggcccggccugcaggccaaggccacccgcgaggcccagaagcgggcggccgccggcaucaugaagaaccccaccgucgacgggaugaccgugaucgaccuggaccccaucccguacgaccccaaguucgagaagcagcucggccaggugaugcugcugguccucugcgugacccaggugcugaugaugcgcaccaccugggcccugugcgaggcccucacccuggcgacggggcccaucuccacccugugggagggcaaccccgggcgguucuggaacaccaccaucgccgucagcauggccaacaucuuccgcggcuccuaccucgccggcgccgggcugcuguucagcaucaugaagaacacggcgaacacccgccggggcaccgggaacaccggcgagacgcucggcgagaaguggaagaaccgccugaacgcccuggggaaguccgaguuccagaucuacaagaaguccggcauccaggagguggaccggacccucgccaaggaggggaucaagcgcggcgagaccgaccaccacgccgugagccgggggagcgcgaagcugcgcugguucgucgagcggaaccuggugaccccggagggcaagguggucgaccucggcugcgggcgcggcgggugguccuacuacugcggcgggcugaagaacgugaaggaggugaagggccugacgaagggcgggcccggccacgaggagcccauccccaugagcaccuacggguggaaccucguccggcugcaguccggcguggacguguucuucaccccgcccgagaagugcgacacccugcucugcgacaucggggagagcucccccaaccccaccgucgaggccggccgcacgcugcgggugcugaaccucguggagaacuggcugaacaacaacacccaguucugcaucaagguccugaacccguacaugcccagcgugaucgagaagauggaggcccugcagcgcaaguacggcggggcccucgugcggaacccccugagccgcaacuccacccacgagauguacugggucagcaacgccuccggcaacaucgugagcuccgugaacaugaucagccggaugcugaucaaccgcuucaccaugcggcacaagaaggcgacguacgagccggacgucgaccucggguccggcacccgcaacaucgggaucgagagcgagacccccaaccuggacaucaucggcaagcggaucgagaagaucaagcaggagcacgagaccuccuggcacuacgaccaggaccaccccuacaagacgugggccuaccacggcagcuacgagaccaagcagaccggguccgccagcuccauggugaacggcgugguccgccugcucaccaagcccugggacgugaucccgauggugacgcagauggccaugaccgacaccacccccuucgggcagcagcgcgucuucaaggagaagguggacacgcggacccaggagcccaaggagggcaccaagaagcugaugaagaucaccgccgaguggcuguggaaggagcucggcaagaagaagacgccccgcaugugcacccgggaggaguucacccgcaagguccggagcaacgcggcccugggggccaucuucaccgacgagaacaaguggaaguccgcccgcgaggccguggaggacagcggcuucugggagcugguggacaaggagcggaaccuccaccuggaggggaagugcgagacgugcgucuacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggagaacucccugagcgggguggagggcgaggggcugcacaagcucggcuacauccugcgcgacgugagcaagaaggagggcggggcgauguacgccgacgacaccgccggcugggacacccggaucacccuggaggaccucaagaacgaggagauggucacgaaccacauggagggggagcacaagaagcuggccgaggccaucuucaagcugaccuaccagaacaagguggugcgcguccagcggccgacgccccgcggcaccgugauggacaucaucucccggcgcgaccagcgggggagcggccagguggucaccuacggccucaacaccuucaccaacauggaggcgcagcugauccgccagauggagggggagggcguguucaaguccauccagcagcugaccgugaaggaggagaucgccgucaagaacuggcucauccggguggggcgcgagcgccugagccggauggccaucuccggcgacgacugcguggucaagccccuggacgaccgcuucgccagcgcccucacggcgcugaacgacaugggcaaggugcggaaggacauccagcagugggagcccucccgcggguggaacgacuggacccaggugccguucugcagccaccacuuccacgagcugaucaugaaggacggccggguccucguggugcccugccgcaaccaggacgagcugaucgggcgggcccgcaucucccagggcgccggguggagccugcgggagaccgccugccucggcaaguccuacgcccagauguggagccugauguacuuccaccgccgggaccugcgccucgcggccaacgccaucugcuccgccguccccagccacuggauccccaccucccggaccacguggagcauccacgccacccacgaguggaugaccaccgaggacaugcugacgguguggaaccgcguguggauccaggagaacccguggauggaggacaagacccccgucgaguccugggaggagauccccuaccugggcaagcgggaggaccaguggugcgggagccucaucggccugaccagccgcgcgaccugggccaagaacauccagacggccaucaaccaggugcggucccugaucgggaacgaggaguacaccgacuacaugcccagcaugaagcgcuuccggcgcgaggaggaggaggccggcgugcucugguga

SEQ ID NO: 9641 - RNA, 9876 nt, Artificial Sequence
  derived and/or modified CDS sequence (opt1) from DENV-2__KC964095__SS-prME
agcgcgggcaugaucaucaugcugauccccaccgugauggccuuccaccucaccacccgcaacggggagccccacaugaucgugagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgaccgcuggugcaacagcaccagcaccugggugaccuacgggaccugcaccaccaccggcgagcaccggcgcgagaagcggagcgucgcccuggugccccacgugggcauggggcucgagacgcgcaccgagaccuggaugagcuccgagggcgccuggaagcacgcccagcggaucgagaccuggauccugcgccaccccggguucacgaucauggccgcgauccuggccuacaccaucggcaccacccacuuccagcgggcccucaucuucauccugcugacggccgucgcgccgcccaugaccaugcgcugcaucgggaucagcaaccgggacuucguggagggcguguccggcgggagcugggucgacaucgugcucgagcacggcuccugcgugaccaccauggccaagaacaagcccacgcuggacuucgagcugaucaagaccgaggccaagcagccggccacccuccgcaaguacugcaucgaggccaagcugaccaacacgaccaccgagagccggugccccacccagggggagcccucccugaaggaggagcaggacaagcgcuucgucugcaagcacagcaucguggaccggggcuggggcaacgggugcggcuccuucgggaagggcgggaucgugacgugcgcgauguucacgugcaagaagaacauggagggcaagaucguccagcccgagaaccucgaguacaccaucguggugaccccgcacagcggcgaggagcacgccaucgggaacgacacgggcaagcacgggaaggagaucaaggucacgccccaguccagcgugaccgaggccgagcugaccggcuacgggaccgugacgaucgagugcagcccccgcaccggccuggacuucaacgagaugguccuccugcagaugggcaacaaggccuggcuggugcaccggcagugguuccucgaccugccccugccguggcuccccggggccgacacccagggcagcaacuggauccagaaggagacccuggugacguucaagaacccccacgcgaagaagcaggacgucgugguccuggggagccaggagggcgccaugcacaccgcccucaccggggccaccgagauccagauguccagcggcaaccugcuguucacgggccaccucaagugcgggcugcgcauggacaagcugcagcucaagggcauguccuacagcaugugcaccgggaaguucaagguggugaaggagaucgccgagacccagcacggcaccaucgucauccgggugcaguacgagggcgacgggucccccugcaagaucccguucgagaucauggaccuggagaagcgcuacgugcugggccggcucaucacggucaaccccaucgugaccgagaaggacagccccgugaacaucgaggcggagcccccguucggggacuccuacaucaucaucggcgucgagcccgggcagcugaagcugaacugguucaagaagggcagcuccaucggccagauguucgagaccaccaugcgcggggccaagcgcauggccauccucggcgacacggccugggacuucgggagccugggcgggguguucaccuccaucggcaaggcccugcaccagguguucggcgcgaucuacggggccgccuucagcggcgucuccuggaccaugaagauccucaucggggugaucaucaccuggaucggcaugaacagccgguccacgagccuguccgugagccugguccugguggggaucgugacccucuaccugggcgucauggugcaggccgacuccggcugcguggucagcuggaagaacaaggagcugaagugcgggagcggcaucuucaucaccgacaacgugcgcaccuggacggagcaguacaaguuccagcccgagucccccagcaagcucgcguccgccauccagaaggcccaggaggaggggaucugcggcauccggagcgugacccgccuggagaaccugauguggaagcagaucaccccggagcucaaccacauccuggccgagaacgaggucaagcugaccaucaugacgggggacaucaagggcaccaugcaggccggcaagcggucccuccgcccccagcccaccgagcugaaguacagcuggaagaccugggggaaggcgaagaugcuguccacggagagccacaaccagaccuuccucaucgacggcccggagaccgccgagugccccaacaccaaccgggccuggaacucccuggagguggaggacuacggguucggcauguucacgaccaacaucuggcugcagcucaaggagaagcaggacgccuucugcgacagcaagcugauguccgccgcgaucaaggacaaccgcgccgugcacgccgacaugggcuacuggaucgagagcgcccugaacgacaccuggaagaucgagaaggccuccuucaucgaggucaagaacugccacuggcccaagagccacacccucugguccaacggggugcuggagagcgagaugaucauccccaagaaccuggcgggcccggugucccagcacaacuaccggcccggguaccacacccagaucgccggccccuggcaccaggggaagcccgagauggacuucgacuucugcgacggcacgaccgucguggugaccgaggacugcggcaaccgcgggccgagccuccggaccacgaccgccagcggcaagcugaucaccgaguggugcugccgcuccugcacccugccgccccugcgguaccgcggggaggacggcugcugguacgggauggagauccggccccugaaggagaaggaggagaaccuggucaacagccucgugacggccggccacggccagaucgacaacuucucccugggggugcugggcauggcccucuuccuggaggagaugcugcgcacccgggucgggaccaagcacgccauccuccugguggccgugagcuucgucacccugaucacgggcaacauguccuucaaggaccucgggcgcgugguggucauggugggcgccaccaugaccgacgacaucggcaugggggugaccuaccuggcccugcucgcggccuucaagguccggccgacguucgccgccggccugcugcuccgcaagcugaccagcaaggagcugaugaugaccaccaucgggaucgugcuccugucccagagcacgauccccgagaccgugcuggagcucaccgacgcccuggcgcugggcaugauggcccucaagaucguccgcgacauggagaaguaccagcuggccgugaccaucauggccauccugugcgugcccaacgccgucauccuccagaacgcguggaagguguccugcacgauccuggccgucgugagcgugagcccccugcuccugaccagcucccagcagaagaccgacuggaucccgcuggcccucaccaucaagggccugaaccccacggccaucuuccugaccacccucagccggaccaacaagaagcgcuccuggccccugaacgaggcgaucauggccgucgggauggugagcauccuggccuccagccuccugaagaacgacauccccaugacgggcccgcugguggccgggggccuccugaccgucugcuacgugcugaccgggcgguccgccgaccucgagcuggagcgcgcgaccgacgugaacugggaggaccaggccgagaucagcggcagcucccccauccugagcaucacgaucuccgaggacggcagcauguccaucaagaacgaggaggaggagcagacccucaccauccugauccggaccgggcugcucgucaucagcggccuguuccccguguccauccccaucaccgccgccgccugguaccugugggaggugaagaagcagcgcgcggggguccucugggacgugccguccccgccgcccaugggcaaggccgagcuggaggacggggccuaccggaucaagcagaagggcgugcugggcuacucccagaucggggccggcgucuacaaggaggggacguuccacaccauguggcacgugacccgcggcgccgugcucaugcacaaggggaagcggaucgagcccagcugggcggacgucaagaaggaccugaucuccuacggcggcggguggaagcugggcggggaguggaaggagggcgaggagguccaggugcucgcccuggagcccgggaagaacccccgcgccguccagaccaagcccggccuguucaagacgaacaccggcaccaucggggccgugagccucgacuucucccccggcaccagcgggucccccaucaucgacaagaagggcaagguggagggccuguacgggaacggcgucgugacgcggagcgggaccuacguguccgccaucgcgcagaccgagaaguccaucgaggacaaccccgagaucgaggacgacaucuuccgcaagaagcggcugaccaucauggaccuccacccgggcgccgggaagacgaagcgcuaccugcccgccaucguccgggaggccaucaagcgcggccugcggacccugauccucgcgcccacccgcgugguggccgccgagauggaggaggcccugcggggccugcccauccgcuaccagaccccggccauccgggcggagcacacggggcgcgagaucgucgaccucaugugccacgccaccuucaccaugcgccugcugucccccgugcgggugcccaacuacaaccucaucaucauggacgaggcccacuucaccgaccccgccagcaucgccgcgcgcggcuacaucagcacgcgggucgagaugggggaggccgccggcaucuucaugaccgccaccccgcccgggucccgcgaccccuucccccagagcaacgccccgaucaucgacgaggagcgggagauccccgagcgcuccuggaacagcggccacgagugggugaccgacuucaagggcaagacggugugguucguccccuccaucaaggcggggaacgacaucgccgccugccugcggaagaacggcaagaaggugauccagcugagccgcaagaccuucgacuccgaguacgugaagacccggaccaacgacugggacuucgucgugacgaccgacaucagcgagaugggggccaacuucaaggcggagcgcgugaucgacccccggcgcugcaugaagccggucauccucaccgacggcgaggagcgggugauccuggccgggcccaugcccgugacccacuccagcgccgcccagcgccggggccgcaucggccggaaccccaagaacgagaacgaccaguacaucuacaugggggagccgcuggagaacgacgaggacugcgcccacuggaaggaggcgaagaugcuccuggacaacaucaacacgcccgagggcaucauccccuccauguucgagccggagcgcgagaaggucgacgccaucgacggggaguaccggcugcgcggcgaggcccgcaagaccuucguggaccucaugcggcgcggggaccugcccguguggcuggccuacaaggucgccgcggagggcaucaacuacgccgaccggcgcuggugcuucgacggcaucaagaacaaccagauccucgaggagaacguggagguggagaucuggaccaaggagggggagcggaagaagcugaagccccgcuggcuggacgcccggaucuacagcgacccccucgcccugaaggaguucaaggaguucgccgcgggccgcaagucccugacccucaaccugaucacggagauggggcggcugccgaccuucaugacccagaagacccgcgacgcccucgacaaccuggccguccugcacacggccgaggcgggcggccgggccuacaaccacgcccucagcgagcugcccgagacccuggagacccuccugcugcucacccugcuggccaccgugaccggcgggaucuuccucuuccugauguccgggcgcgggaucgggaagaugacccugggcaugugcugcaucaucaccgccagcauccuccugugguacgcgcagauccagccccacuggaucgccgccuccaucauccuggaguucuuccucaucguccugcugauccccgagccggagaagcagcggacgccccaggacaaccagcucacguacguggugaucgccauccugaccgucguggccgcgaccauggccaacgagaugggcuuccuggagaagaccaagaaggaccucgggcugggcagcaucacgacccagcagcccgaguccaacauccuggacaucgaccugcccccggccagcgccuggacccucuacgccguggcgaccacguucgucacccccaugcugcgccacagcaucgagaacuccagcgugaacgugucccucaccgccaucgccaaccaggccaccguccugauggggcugggcaagggguggccccucagcaagauggacaucggcgugccccugcuggccaucggcugcuacucccaggugaacccgaucacgcucaccgcggcccugcugcuccuggucgcccacuacgccaucaucgggcccggccugcaggcgaaggccacccgggaggcccagaagcgcgccgccgcggggaucaugaagaaccccaccguggacggcaucacggugaucgaccucgaccccaucccguacgaccccaaguucgagaagcagcuggggcaggucaugcugcucgugcugugcgugacccagguccugaugaugcggaccaccugggcccucugcgaggcccugacgcuggccaccggccccaucagcacccucugggagggcaaccccgggcgcuucuggaacaccacgaucgccguguccauggcgaacaucuuccggggcagcuaccuggccggggccggccuccucuucuccaucaugaagaacaccaccaacacccgccggggcacggggaacaucggcgagacccugggggagaaguggaagucccgccugaacgcccucggcaaguccgaguuccagaucuacaagaaguccgggauccaggagguggaccgcacccuggccaaggagggcaucaagcggggcgagaccgaccaccacgcggucucccgcgggagcgccaagcugcggugguucguggagcgcaacauggugacgccggagggcaaggucguggaccucgggugcggccgcggcgggugguccuacuacugcggcgggcugaagaacgugcgcgaggucaaggggcugaccaagggcggccccgggcacgaggagcccauccccaugagcaccuacggcuggaaccucgugcggcugcaguccggcguggacgucuucuucaucccgcccgagaagugcgacacccugcucugcgacaucggggaguggagccccaacccgaccguggaggccggccgcacgcugcgggugcugaaccucgucgagaacuggcugaacaacaacacccaguucugcaucaaggugcugaaccccuacaugcccuccgugaucgagaagauggagacccuccagcgcaaguacgggggcgcccugguccggaacccccugagccgcaacagcacccacgagauguacuggguguccaacgcgagcgggaacaucguguccagcgucaacaugaucucccggaugcugaucaaccgcuucacgaugcggcacaagaaggccaccuacgagccggacguggaccucggcagcggcacccgcaacaucgggaucgaguccgagacccccaaccuggacaucaucggcaagcggaucgggaagaucaagcaggagcacgagacgagcuggcacuacgaccaggaccaccccuacaagaccugggccuaccacggcuccuacgagaccaagcagaccggcagcgccuccagcaugguggacggggucgugcgccugcucacgaagcccugggacgugaucccgauggucacccagauggccaugaccgacaccacgcccuucggccagcagcggguguucaaggagaagguggacacccgcacccaggagcccaaggaggggaccaagaagcugaugaagaucacggcggaguggcuguggaaggagcucggcaagaaggagacgccccggaugugcacccgggaggaguucacccgcaagguccgguccaacgccgcccugggggccaucuucacggacgagaacaaguggaaguccgcccgcgaggcgguggaggacuccggcuucugggagcugguggacaaggagcggaaccuccaccuggagggcaagugcgagaccugcgucuacaacaugauggggaagcgcgagaagaagcugggcgaguucgggaaggccaagggcagccgggccaucugguacauguggcucggggcccgcuuccuggaguucgaggcccugggcuuccucaacgaggaccacugguucucccgggagaacagccuguccggcguggagggggagggccugcacaagcucggguacauccugcgcgacgucagcaagaaggagggcggggcgauguacgccgacgacaccgccggcugggacacccggaucacgcuggaggaccucaagaacgaggagauggugaccaaccacauggagggcgagcacaagaagcuggccgaggcgaucuucaagcugaccuaccagaacaaggugguccgcgugcagcggccgccgccccgcgggaccgugauggacaucaucagccggcgcgaccagcggggcuccgggcaggucgugacguacggccucaacaccuucaccaacauggaggcccagcugauccgccagauggagggcgaggggguguucaagaacauccagcaccugaccgucacggaggagaucgccgugcagaacuggcucgcccgggugggccgcgagcggcugagccgcauggccaucuccggggacgacugcgucgugaagccccuggacgaccgcuucgcgagcgcccucaccgcccugaacgacgugggcaagauccggaaggacauccagcagugggagcccucccgcgggugggacgacuggacccagguccccuucugcagccaccacucccacgagcugaucaugaaggacggccgggugcucgugguccccugccgcaaccaggacgagcugaucggccgggcccgcaucagccagggggccggcuggucccugcgggagaccgcgugccucggcaagagcuacgcccagauguggucccugauguacuuccaccgccgggaccugcgccucgccgccaacgccaucugcagcgcggugcccucccacugggugccgaccagccggacgaccugguccauccacgccaagcacgaguggaugaccaccgaggacaugcugacggucuggaaccgcguguggauccaggagaaccccuggauggaggacaagacccccguggagagcugggaggagauccccuaccugggcaagcgggaggggcaguggugcggcucccucaucggccugaccagccgcgccaccugggccaagaacauccagacggccaucaaccagguccggagccugaucgggaacgaggaguacaccgacuacaugccguccaugaagcgcuuccggcgcgaggaggaggaggcgggcgugcucugguga

SEQ ID NO: 9642 - RNA, 9876 nt, Artificial Sequence
  derived and/or modified CDS sequence (opt1) from DENV-2__KC964094__SS-prME
agcgccggcaugaucaucaugcugauccccaccgugauggccuuccaccucaccacccgcaacggggagccccacaugaucgucagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacuccaccagcaccugggugaccuacgggaccugcaccaccaccggcgagcaccgccgggagaagcgcuccgucgcccuggugccccacgugggcauggggcucgagacccggaccgagaccuggaugagcuccgagggcgccuggaagcacgcccagcgcaucgagaccuggguccugcggcaccccggguucaccaucauggccgcgauccuggccuacaccaucggcaccaccuacuuccagcgcgugcucaucuucauccugcugacggccguggcccccagcaugaccaugcgguccaucgggaucagcaaccgcgacuucgucgagggcguguccggcgggagcuggguggacgucgugcucgagcacggcuccugcgugaccaccauggcgaagaacaagcccacgcuggacuucgagcugaccaagaccgaggccaagcaccccgccacccuccggaaguacugcaucgaggccaagcugacgaacaccaccaccgccagccgcugcccgacgcagggggagcccucccugaacgaggagcaggacaagcgguucgucugcaagcacagcaugguggaccgcggcuggggcaacgggugcggccucuucgggaagggcgggaucgugaccugcgcgauguucacgugcaagaagaacauggagggcaaggucgugcagcccgagaaccuggaguacaccaucgugaucacgccccacuccggcgaggagaacgccgucgggaacgacaccggcaagcacgggaaggagaucaaggugaccccgcagagcuccgugaccgaggccgagcugaccggcuacgggacggucaccauggagugcagcccccggaccggccucgacuucaacgagauggugcugcugcagaugaagaacaaggccuggcucguccaccgccagugguuccuggaccugccccuccccuggcugccgggcgccgacacccaggggagcaacuggauccagaaggagacgcuggugaccuucaagaacccccacgcgaagaagcaggacguggucgugcucggcucccaggagggggccaugcacaccgcccugaccggcgccacggagauccagaugagcuccgggaaccugcuguucaccggccaccugaagugccggcugcgcaccgacaagcuccagcugaagggcaugagcuacuccaugugcaccgggaaguucaagguggucaaggagaucgccgagacgcagcacggcaccaucgugauccgggugcaguacgagggggacggcagccccugcaagauccccuucgagaucauggaccuggagaagcgccacguccucggccggcugaucaccgugaacccgaucgugaccgagaaggacucccccgucaacaucgaggcggagccgcccuucggggacagcuacaucaucaucggcguggagccggggcagcugaagcucuccugguucaagaaggagagcuccaucggccagauguucgagacgaccaugcgcggggccaagcgcauggccauccugggcgacaccgccugggacuucggcagccucggcgggguguucaccuccaucgggaaggcccuccaccaggucuucggggcgaucuacggggccgccuucagcggcguguccuggacgaugaagauccugaucggcguggucaucaccuggaucgggaugaacagccgguccaccagccuguccgugagccuggugcucgucggcguggugacccuguaccugggggucauggugcaggccgacagcggcugcguggucuccuggaagaacaaggagcucaagugcgggagcggcaucuucgugacggacaacgugcacaccuggaccgagcaguacaaguuccagcccgagucccccagcaagcuggcguccgccauccagaaggcccacgaggagggcaucugcgggauccgcagcgucacccggcuggagaaccucauguggaagcagaucacgcccgagcugaaccacauccuguccgagaacgaggugaagcucaccaucaugaccggcgacaucaaggggaucaugcaggccggcaagcgcagccugcggccgcagcccaccgagcugaaguacuccuggaaggccugggggaaggcgaagaugcucagcacggagcugcacaaccacaccuuccugaucgacggccccgagaccgccgagcgcccgaacaccaaccgggccuggaacucccucgagguggaggacuacggcuucggggucuucacgaccaacaucuggcugaagcugaaggagcgccaggacguguucugcgacagcaagcucauguccgccgccaucaaggacaaccgggcggugcacgccgacaugggcuacuggaucgagagcgcccugaacgacaccuggaagaucgagaaggccuccuucaucgaggucaagagcugccacuggcccaagucccacacccuguggagcaacggggugcucgagagcgagaugaucauccccaagaacuucgccggccccgugucccagcacaacuaccgcccgggcuaccacacccagacggcggggcccuggcaccugggccggcuggagauggacuucgacuucugcgaggggaccaccgucguggugaccgaggacugcggcaaccgcgggcccagccuccggacgaccaccgccuccggcaagcugaucaccgaguggugcugccgcagcugcacgcugcccccgcuccgguaccgcggcgaggacgggugcugguacggcauggagauccggccccugaaggagaaggaggagaaccuggucaacucccucgugaccgccgggcacggccagaucgacaacuucagccugggggugcugggcauggcccucuuccuggaggagaugcugcgcacccgggucggcaccaagcacgcgauccuccugguggccguguccuucgucacgcugaucaccgggaacaugagcuuccgcgaccucggccgcgugauggugauggucggggccaccaugaccgacgacaucggcaugggggugacguaccuggcccugcucgccgcguucaagguccggcccaccuucgccgccggccugcugcuccgcaagcugaccuccaaggagcugaugaugaccacgaucggcaucgugcuccugagccaguccaccauccccgagaccauccuggagcucaccgacgcccuggcccuggggaugauggugcucaagaucguccggaacauggagaaguaccagcuggcggugacgaucauggccauccugugcgugccgaacgccgucauccuccagaacgccuggaaggugagcugcaccacccuggccguggucuccgugagcccccugcuccugaccuccagccagcagaaggcggacuggaucccccuggcccucacgaucaagggccugaaccccaccgccaucuuccugaccacccucucccgcacgagcaagaagcgguccuggccgcugaacgaggccaucauggcgguggggauggucagcauccuggccagcucccuccugaagaacgacauccccaugaccggcccccugguggccggcgggcuccugaccgugugcuacguccuggccggccgcagcgccgaccucgagcuggagcgggcggccgacgugcgcugggaggagcaggccgagaucuccgggagcucccccauccugagcaucaccaucuccgaggacggcgggaugagcaucaagaacgaggaggaggagcagacgcucaccauccugauccggaccggccugcucgugaucuccggccuguucccggucagcauccccaucaccgccgccgcgugguaccugugggaggugaagaagcagcgcgccggggugcucugggacguccccagcccgccgcccgugggcaaggccgagcuggaggacggggccuaccggaucaagcagaagggcauccugggguacagccagaucggcgccggcguguacaaggaggggaccuuccacacgauguggcacgucacccgcggcgcggugcucaugcacaaggggaagcggaucgagcccuccugggccgacgugaagaaggaccugaucagcuacggcgggggcuggaagcuggagggcgaguggaaggagggggaggagauccagguccucgcccuggagcccggcaagaacccccgcgccgugcagaccaagcccgggcuguucaagaccaacacgggcaccaucggggccgugucccucgacuucagccccggcaccuccggcagccccaucgucgacaagaaggggaagguggugggccuguacgggaacggcgucgugacccgguccggcacguacgugagcgcgaucgcccagaccgagaaguccaucgaggacaaccccgagaucgaggacgacaccuuccgcaagaagcggcugaccaucauggaccugcaccccggggccggcaagacgaagcgcuaccuccccgccaucguccgggaggcgaucaagcgcgggcugcggacccugauccucgccccgacccgcgugguggccgccgagauggaggaggcccugcgcggccugcccauccgguaccagacccccgcgauccgcgccgagcacacggggcgggagaucgucgaccucaugugccacgccaccuucaccaugcgccugcugucccccauccgggugccgaacuacaaccucaucaucauggacgaggcccacuucaccgaccccgccagcaucgcggcccgcggcuacaucuccacgcggguggagaugggcgaggccgccgggaucuucaugaccgccacgccgcccggcagccgcgacccguucccccaguccaacgcgcccaucauggacgaggagcgggagauccccgagcgcagcuggaacuccgggcacgagugggucaccgacuucaagggcaagacggugugguucgugccgagcaucaaggccgggaacgacaucgccgccugccugcggaagaacggccgcaaggucauccagcugucccggaagaccagcgacuccgaguacaucaagacccgcaccaacgacugggacuucguggugacgaccgacaucagcgagaugggcgcgaacuucaaggccgagcgggucaucgacccccgccggugcaugaagcccgugauccucaccgacggggaggagcgcgugauccuggccggccccaugccggucacccacuccagcgccgcccagcggcgcgggcgcgugggccggaaccccaagaacgagaacgaccaguacaucuacaugggggagccccuggagaacgacgaggacugcgcgcacuggaaggaggccaagaugcuccuggacaacaucaacacgcccgagggcaucaucccguccauguucgagcccgagcgcgagaaggucgacgccaucgacggcgaguaccggcugcgcggggaggcccggaagaccuucguggaccucaugcgccggggcgaccugcccguguggcuggccuaccgcgucgcggccgaggggaucaacuacgccgaccggcgcuggugcuucgacggcgugaagaacaaccagauccucgaggagaacguggaggucgagaucuggaccaaggagggggagcggaagaagcugaagccgcgcuggcuggacgcccggaucuacagcgacccccucgcccugaaggaguucaaggaguucgcggccggccgcaagucccugacccucaaccugaucacggagaugggccggcugcccaccuucaugacccagaaggcccgcaacgcccucgacaaccuggcggugcugcacaccgccgaggccgggggccgggccuacaaccacgcccucagcgagcugcccgagacgcuggagacccuccugcugcucacccugcuggcgaccgugaccgggggcaucuuccucuuccugauguccggcaaggggaucggcaagaugacgcuggggaugugcugcaucaucaccgccagcauccuccugugguacgcccagauccagccgcacuggaucgccgccagcaucauccuggaguucuuccucaucguccugcugauccccgagcccgagaagcagcgcacgccccaggacaaccagcucaccuacguggugaucgcgauccugacggucguggccgccaccauggccaacgagaugggcuuccuggagaagaccaagaaggacuucgggcucggcuccaucgccacccagcagccggagagcaacauccuggacaucgaccugcggcccgcguccgccuggacgcucuacgccguggccaccaccuucaucacccccaugcugcgccacagcaucgagaacuccagcgucaacgugucccugacggccaucgcgaaccaggccaccgugcucaugggccuggggaagggcuggccccugagcaagauggacaucggggucccgcuccuggccaucggcugcuacucccaggugaaccccaucacccugaccgccgcgcuccugcugcucguggcccacuacgccaucaucgggcccggccugcaggccaaggccacgcgggaggcgcagaagcgcgccgccgccggcaucaugaagaaccccaccgucgacgggaucaccgugaucgaccuggacccgauccccuacgaccccaaguucgagaagcagcucggccaggugaugcugcugguccucugcgugacccaggugcugaugaugcgcacgaccugggcccugugcgaggcgcucacccuggccaccgggcccaucagcacgcugugggagggcaacccggggcgguucuggaacaccaccaucgccgucuccauggccaacaucuuccgcggcagcuaccucgccggcgcggggcugcuguucuccaucaugaagaacaccgccaacacgcggcgcggcaccgggaacaccggcgagacccucggcgagaaguggaagaaccggcugaacgcccugggcaagagcgaguuccagaucuacaagaaguccggcauccaggagguggaccgcacgcucgccaaggaggggaucaagcggggcgagaccgaccaccacgcggugagccgcggguccgccaagcugcggugguucgucgagcgcaaccuggugacccccgagggcaagguggucgaccucggcugcgggcggggcggguggagcuacuacugcggcgggcugaagaacgugaaggaggugaagggccugaccaagggcgggcccggccacgaggagcccaucccgauguccacguacggguggaaccucguccgccugcagagcggcguggacguguucuucacgccgcccgagaagugcgacacccugcucugcgacaucggggagagcucccccaacccgaccgucgaggccggccggacccugcgcgugcugaaccucguggagaacuggcugaacaacaacacgcaguucugcaucaagguccugaaccccuacaugcccagcgugaucgagaagauggaggcccugcagcggaaguacggcggggcccucgugggcaacccgcugucccgcaacagcacccacgagauguacugggcguccaacgccagcgggaacaucgucuccagcgugaacaugaucucccggaugcugaucaaccgcuucaccaugcggcacaagaaggccaccuacgagcccgacguggaccucggcagcgggacgcgccacaucggcaucgaguccgagacccccaaccuggacaucaucggcaagcgcaucgagaagaucaagcaggagcacgagaccagcuggcacugcgaccaggaccaccccuacaagaccugggccuaccacggguccuacgaggccaagcagacgggcagcgcguccagcauggucaacgggguggugcggcugcucaccaagccgugggacgucauccccauggugacccagauggccaugaccgacacgacccccuucggccagcagcgcgucuucaaggagaagguggacacccggacccaggagcccaaggagggcacgaagaagcugaugaagaucaccgccgaguggcuguggaaggagcucgggaagaagaaggccccgcgcaugugcacccgggaggaguucacccgcaaggugcgguccaacgccgcgcugggcgccauguucacggacgagaacaaguggaaguccgcccgcgaggccgucgaggacuccggguucugggagcugguggacaaggagcggaaccuccaccuggagggcaagugcgagaccugcguguacaacaugauggggaagcgcgagaagaagcugggcgaguucggcaaggcgaaggggagccgggccaucugguacauguggcucggcgcccgcuuccuggaguucgaggcccugggguuccucaacgaggaccacugguucagccgggagaacucccugagcggcgucgagggggagggccugcacaagcucggcuacauccugcgcgacguguccaagaaggagggcggggccauguacgcggacgacaccgccgggugggacacccggaucacgcuggaggaccucaagaacgaggagauggugaccaaccacauggagggcgagcacaagaagcuggccgaggccaucuucaagcugaccuaccagaacaaggucgugcgcgugcagcggcccacgccccgcgggacggucauggacaucaucagccggcgcgaccagcggggcuccggccagguggugaccuacgggcucaacaccuucaccaacauggaggcccagcugauccgccagauggagggcgagggggucuucaagagcauccagcaccugacggugaccgaggagaucgcggugaagaacuggcucguccgcgugggccgggagcgccugucccggauggccaucagcggcgacgacugcguggucaagccccuggacgaccgcuucgccuccgcccucaccgcccugaacgacauggggaaggugcggaaggacauccagcagugggagccgagccgcggcuggaacgacuggacccaggugcccuucugcucccaccacuuccacgagcugaucaugaaggacgggcggguccucguggugcccugccgcaaccaggacgagcugaucggccgggcgcgcaucagccagggggccggcuggucccugcgggagacggccugccucggcaagagcuacgcccagauguggucccugauguacuuccaccgccgggaccugcgccucgccgcgaacgccaucugcagcgccguccccucccacugggugccgaccagccggaccaccuggagcauccacgccacccacgaguggaugacgaccgaggacaugcugaccguguggaaccgcgucuggauccaggagaaccccuggauggaggacaagacccccguggaguccugggaggagauccccuaccuggggaagcgggaggaccaguggugcggcagccucaucgggcugacgucccgcgcgaccugggccaagaacauccagaccgccaucaaccaggugcggagccugaucggcaacgaggaguacaccgacuacaugccguccaugaagcgcuuccgccgggaggaggaggaggccgggguccucugguga

SEQ ID NO: 9643 - RNA, 9876 nt, Artificial Sequence
  derived and/or modified CDS sequence (opt1) from DENV-2__KC964093__SS-prME
accgccggggugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccuccaccugggugacguacgggaccugcaccgccaccggcgagcaccggcgggagaagcggagcguggcccuggucccccacgugggcauggggcuggagacgcgcaccgagaccuggauguccagcgagggcgccuggaagcacgcccagcggaucgagaccugggugcuccgccaccccggguucacgaucauggccgccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaccaagaccgaggccaagcaccccgccacccugcgcaaguacugcaucgaggccaagcucacgaacaccaccaccgcgagccggugcccgacgcagggggagcccucccugaacgaggagcaggacaagcgcuucgugugcaagcacagcaugguggaccggggcuggggcaacgggugcggccuguucgggaagggcgggaucgugaccugcgccauguucacgugcaagaagaacauggagggcaagguggugcagcccgagaaccucgaguacaccaucgucaucacgccccacuccggcgaggagaacgugguggggaacgacaccggcaagcacgggaaggagaucaaggucaccccgcagagcuccaucaccgaggccgagcugaccggcuacgggacggugaccauggagugcagcccccgcaccggccuggacuucaacgagaugguccuccugcagauggaggacaaggccuggcuggugcaccggcagugguuccucgaccugccccugcccuggcucccgggcgccgacacccagggguccaacuggauccagaaggagacgcuggugaccuucaagaacccccacgcgaagaagcaggacgucguggugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaaggccgucaaggagaucgcggagacccagcacggcacgaucgugauccgcgugcaguacgagggggacggcagccccugcaagauccccuucgagaucauggaccuggagaagcggcacguccugggccgccucaucaccgugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccacgaugcgcggcgccaagcggauggccauccucggcgacaccgccugggacuucgggagccugggcgggguguucaccuccaucggcaaggcgcugcaccaggucuucggggccaucuacggcgccgccuucagcggcguguccuggaccaugaagauccucaucgggguggucaucacguggaucggcaugaacagccgcuccaccagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacacguggaccgagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugacgaucaugaccggggacaucaagggcaucaugcaggccgggaagcggagccuccgcccgcagcccaccgagcugaaguacuccuggaaggcguggggcaaggccaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuucugcgacagcaagcugauguccgccgcgaucaaggacaaccgggccgugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggaagcuggagauggacuucgacuucugcgagggcacgaccguggucgugaccgaggacugcgggaaccggggccccagccugcgcaccacgaccgccuccggcaagcucaucaccgaguggugcugccggagcugcacccugcccccgcugcgcuaccgcggggaggacggcugcugguacgggauggagauccgcccccucaaggagaaggaggagaaccuggugaacucccuggucacggccggccacgggcagaucgacaacuucagccucggcgugcugggcauggcgcuguuccucgaggagaugcugcggacccgcguggggaccaagcacgccauccugcucgucgccguguccuucgugacccugaucacgggcaacaugagcucccgggaccuggggcgcgucauggugauggugggcgccaccaugaccgacgacaucgggaugggcgucaccuaccucgcccugcuggcggccuucaaggugcgccccacguucgccgccggccuccugcugcggaagcucaccagcaaggagcugaugaugaccaccaucgggaucguccugcucucccagagcuccauccccgagacgauccuggagcugaccgacgcccucgcgcugggcaugauggugcugaagaucgugcgcaacauggagaaguaccagcucgccgucaccaucauggccauccugugcgugccgaacgccgugauccugcagaacgccuggaaggucagcugcaccacgcucgcggugguguccgucagcccccugcugcucaccuccagccagcagaaggccgacuggaucccccuggcccugaccaucaaggggcucaaccccaccgccaucuuccugacgacccugucccggaccagcaagaagcgcuccuggccgcucaacgaggcgaucauggccgugggcauggugagcauccuggccagcucccugcucaagaacgacauccccaugaccggcccccuggucgccgggggccugcucacggugugcuacgugcuggccgggcggagcgcggaccuggagcucgagcgcgccgccgacguccggugggaggagcaggccgagaucuccggcagcucccccauccugagcaucaccaucuccgaggacgggggcaugagcaucaagaacgaggaggaggagcagacccugaccauccucauccgcacgggccugcuggugaucuccggccucuucccggugagcauccccaucaccgccgcggccugguaccugugggaggucaagaagcagcgggccggcgugcugugggacgugcccagcccgccgcccgucgggaaggccgagcucgaggacggcgccuaccgcaucaagcagaaggggauccugggcuacagccagaucggcgcggggguguacaaggagggcaccuuccacaccauguggcacgugacccgcggggccguccugaugcacaagggcaagcgcaucgagcccuccugggccgacgugaagaaggaccucaucagcuacgggggcggcuggaagcuggagggggaguggaaggagggcgaggagauccaggugcuggcccucgagcccgggaagaacccccgggccguccagacgaagcccggccuguucaagaccaacaccgggaccaucggcgcggugucccuggacuucagccccggcacguccgggagccccaucguggacaagaagggcaaggucguggggcucuacggcaacggcguggucacccgcuccgggaccuacgugagcgccaucgcccagaccgagaaguccaucgaggacaaccccgagaucgaggacgacaucuuccggaagaagcgccugacgaucauggaccugcaccccggcgccgggaagaccaagcgguaccugcccgcgaucgugcgcgaggccaucaagcggggccuccgcacccugauccuggccccgacccgggucguggccgccgagauggaggaggcgcuccgcgggcugcccauccgcuaccagacgcccgccauccgggccgagcacaccggccgcgagaucguggaccugaugugccacgccaccuucaccaugcggcuccugucccccauccgcgucccgaacuacaaccugaucaucauggacgaggcccacuucacggaccccgcgagcaucgccgcccggggcuacaucuccacccgcguggagaugggggaggccgccggcaucuucaugaccgcgacgccgcccgggagccgggacccguucccccaguccaacgcccccaucauggacgaggagcgcgagauccccgagcggagcuggaacuccggccacgagugggugacggacuucaaggggaagaccgucugguucgugccgagcaucaaggccggcaacgacaucgccgcgugccuccgcaagaacggcaagaaggugauccagcugucccggaagaccuucgacagcgaguacgucaagacccgcacgaacgacugggacuucguggugaccaccgacaucuccgagaugggggccaacuucaaggccgagcgggucaucgacccccgccggugcaugaagcccgugauccugaccgacggcgaggagcgcgugauccucgccgggcccaugccggucacgcacagcuccgccgcgcagcggcgcggccggguggggcgcaaccccaagaacgagaacgaccaguacaucuacaugggcgagccccuggagaacgacgaggacugcgcccacuggaaggaggccaagaugcugcucgacaacaucaacacccccgagggcaucaucccgagcauguucgagcccgagcgcgagcgggucgacgccaucgacggggaguaccgccugcggggcgaggcccgcaagaccuucguggaccugaugcggcgcggggaccuccccguguggcuggcguaccgggucgccgccgagggcaucaacuacgccgaccgccgguggugcuucgacggggugaagaacaaccagauccuggaggagaacguggaggucgagaucuggaccaaggagggcgagcgcaagaagcucaagccgcgguggcuggacgcccgcaucuacuccgacccccuggcgcucaaggaguucaaggaguucgccgccggccgcaagagccugacgcugaaccucaucaccgagauggggcgccugcccaccuucaugacccagaaggcccggaacgcgcuggacgaccucgccgugcugcacacggccgaggccggcgggcgcgccuacaaccacgcgcuguccgagcuccccgagacccuggagacccugcuccugcugacccuccuggccacggugaccggcggcaucuuccuguuccucaugagcgggaagggcaucgggaagaugacccugggcaugugcugcaucaucaccgccuccguccugcucugguacgcccagauccagccgcacuggaucgccgcgagcaucauccuggaguucuuccugaucgugcuccugauccccgagcccgagaagcagcggacgccccaggacaaccagcugacguacguggccaucgccauccucaccgucguggccgccaccauggcgaacgagaugggguuccuggagaagaccaagaaggacuucggccugggcagcaucgccacgcagcagccggaguccaacauccucgaccuggaccugcgccccgccagcgccuggacccucuacgccguggcgaccaccuucaucacgcccaugcugcggcacuccaucgagaacagcuccgucaacgugagccugaccgccaucgccaaccaggccaccgugcucauggggcugggcaagggguggccccuguccaagauggacaucggcgucccgcuccuggcgaucgggugcuacagccaggugaaccccaucacccugacggccgcccuccugcugcucguggcccacuacgccaucaucggccccggccugcaggcgaaggccacccgcgaggcccagaagcgggccgccgcggggaucaugaagaaccccaccgucgacggcaucaccgugaucgaccuggacccgauccccuacgaccccaaguucgagaagcagcucgggcaggucaugcugcugguccucugcgugacccaggugcugaugaugcgcaccaccugggcccugugcgaggcccucacccuggccacgggccccaucuccacccugugggaggggaacccgggccgcuucuggaacaccaccaucgccgucagcauggcgaacaucuuccggggcuccuaccucgccggggugggccugcuguucagcaucaugaagaacacggccaacacccgccgggggaccggcaacaccggcgagacgcucggggagaaguggaagaaccgccugaacgcccugggcaaguccgaguuccagaucuacaagaaguccgggauccaggagguggaccggacccucgcgaaggagggcaucaagcgcggggagaccgaccaccacgccgucucccggggcagcgccaagcugcgcugguucguggagcggaaccuggugacccccgagggcaaggucauggaccucgggugcggccgcgggggcugguccuacuacugcgggggccugaagaacgugaaggaggugaagggccugacgaagggcgggcccgggcacgaggagcccaucccgaugagcaccuacggcuggaaccucguccggcugcaguccgggguggacguguucuucgcgccgcccgagaagugcgacacccugcucugcgacaucggcgagagcagccccaacccgaccgucgaggccggccgcacgcugcgggugcugaaccucguggagaacuggcugaacaacaacacccaguucugcaucaagguccugaaccccuacaugcccuccgugaucgagaagauggaggcgcugcagcgcaaguacgggggcgcccucgugcggaacccgcugagccgcaacuccacccacgagauguacugggucagcaacgccuccgggaacaucgugagcuccgugaacaugaucagccggaugcugaucaaccgcuucaccaugcggcacaagaaggccaccuacgagcccgacgucgaccucggcuccgggacgcgcaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagaccaagcagacgggcuccgcgagcuccauggugaacggggugguccggcugcucaccaagccgugggacgugauccccauggucacccagauggccaugaccgacacgacccccuucggccagcagcgcguguucaaggagaagguggacacccggacccaggagcccaaggagggcacgaagaagcugaugaagaucaccgccgaguggcuguggaaggagcucgggaagaagaagaccccgcgcaugugcacccgggaggaguucacgcgcaagguccggagcaacgccgcccugggcgcgaucuucaccgacgagaacaaguggaaguccgcccgcgaggccguggaggacagcggguucugggagcugguggacaaggagcggaaccuccaccuggagggcaagugcgagaccugcgucuacaacaugauggggaagcgcgagaagaagcugggcgaguucggcaaggccaaggggucccgggcgaucugguacauguggcucggcgcccgcuuccuggaguucgaggcccugggguuccucaacgaggaccacugguucagccgggagaacagccuguccggcguggagggggagggccugcacaagcucggcuacauccugcgcgaggugagcaagaaggagggcggggccauguacgccgacgacaccgcggggugggacacgcggaucacccuggaggaccucaagaacgaggagauggucaccaaccacauggagggcgagcacaagaagcuggccgaggccaucuucaagcugaccuaccagaacaagguggugcgcguccagcggcccacgccccgcgggaccgugauggacaucaucucccggcgcgaccagcggggcagcggccagguggucaccuacgggcucaacaccuucacgaacauggaggcccagcugauccgccagauggagggcgaggggguguucaaguccauccagcaccugaccgugaccgaggagaucgccgucaagaacuggcucacccgcgugggccgggagcgccugagccggauggcgaucuccggcgacgacugcguggucaagccccuggacgaccgcuucgccagcgcccucacggcccugaacgacauggggaaggugcggaaggacauccagcagugggagccgucccgcggcuggaacgacuggacccaggugcccuucugcagccaccacuuccacgagcugaucaugaaggacgggcggguccucguggugcccugccgcaaccaggacgagcugaucggccgggcccgcaucucccagggggcgggcuggagccugcgggagaccgccugccucggcaaguccuacgcccagauguggagccugauguacuuccaccgccgggaccugcgccucgccgccaacgcgaucugcuccgccguccccagccacugggugccgaccucccggacgaccuggagcauccacgccacccacgaguggaugaccaccgaggacaugcugacgguguggaaccgcgucuggauccaggagaaccccuggauggaggacaagacccccguggagagcugggaggagauccccuaccuggggaagcgggaggaccaguggugcggcucccucaucgggcugaccagccgcgccaccugggcgaagaacauccagacggccaucaaccaggugcggucccugaucggcaacgaggaguacaccgacuacaugccgagcaugaagcgcuuccgccgggaggagggggaggccggcguccucugguga

SEQ ID NO: 9644 - RNA, 9876 nt, Artificial Sequence
  derived and/or modified CDS sequence (opt1) from DENV-2__DQ448231__SS-prME
accgccggggugaucaucaugcugauccccaccgccauggcguuccaccucaccacccggaacggggagccccacaugaucgucagccggcaggagaagggcaagagccugcuguucaagaccgaggacggggugaacaugugcacccucauggccauggaccugggcgagcugugcgaggacaccaucaccuacaacugcccccuccugcggcagaacgagcccgaggacaucgacugcuggugcaacagcaccuccaccugggugaccuacgggaccugcaccgccaccggcgagcaccggcgcgagaagcggagcgucgcccuggugccccacgugggcauggggcucgagacccgcaccgagaccuggauguccagcgagggcgccuggaagcacgcgcagcggaucgagaccuggauccugcgccaccccggguucacgaucauggccgccauccuggccuacaccaucggcaccaccuacuuccagcggguccucaucuucauccugcugacggcgguggcccccuccaugaccaugcgcugcaucgggaucagcaaccgggacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccgcaaguacugcaucgaggcgaagcugaccaacacgaccaccgccagccggugccccacccagggggagcccucccugaacgaggagcaggacaagcgcuucgugugcaagcacagcaugguggaccggggcuggggcaacgggugcggccucuucgggaagggcgggaucgucacgugcgccauguucacgugcaagaagaacauggagggcaagaucgugcagcccgagaaccuggaguacaccaucguggucacgccccacuccggcgaggagaacacgguggggaacgacaccggcaagcacgggaaggagaucaaggugaccccgcagagcuccaucaccgaggccgagcugaccggcuacgggacggucaccauggagugcagcccccgcaccggccucgacuucaacgagauggugcugcugcagauggagaacaaggccuggcucgugcaccggcagugguuccuggaccugccccuccccuggcugccgggcgcggacacccagggguccaacuggauccagaaggagacgcuggucaccuucaagaacccccacgccaagaagcaggacguggucgugcucggcagccaggagggggccaugcacaccgcccugaccggcgccacggagauccagaugagcuccgggaaccuccuguucaccggccaccugaagugccgccugcggauggacaagcuccagcugaagggcaugagcuacuccaugugcaccgggaaguucaagguggucaaggagaucgcggagacccagcacggcacgaucguggugcgcguccaguacgagggggacggcagccccugcaagauccccuucgagaucauggaccuggagaagcggcacgugcucggccgccugaucaccgugaacccgaucgucaccgagaaggacucccccgugaacaucgaggccgagccgcccuucggggacagcuacaucaucaucggcguggagccggggcagcugaagcucuccugguucaagaagggcagcuccaucgggcagauguucgagaccacgaugcgcggcgccaagcggauggccauccugggcgacaccgccugggacuucgggagccugggcggggucuucaccuccaucggcaaggcgcuccaccagguguucggggccaucuacggcgccgccuucagcggcguguccuggaccaugaagauccugaucggggucgugaucacguggaucggcaugaacagccgcuccaccagccuguccgugagccugguccucguggggguggucacccuguaccugggcgugauggugcaggcggacuccgggugcgucgugagcuggaagaacaaggagcucaagugcggcagcggcaucuucaucaccgacaacgugcacacguggaccgagcaguacaaguuccagcccgagucccccagcaagcuggccuccgccauccagaaggcccacgaggaggggaucugcggcauccggagcgucacccgccuggagaaccucauguggaagcagaucacccccgagcugaaccacauccuguccgagaacgaggugaagcucacgaucaugaccggggacaucaagggcaucaugcaggccgggaagcggagccugcgcccgcagcccaccgagcugaaguacuccuggaagaccuggggcaaggcgaagauccucagcacggagccccacaaccagaccuuccugaucgacggcccggagaccgccgagugccccaacaccaaccgggccuggaacucccuggagguggaggacuacggguucggcgucuucacgaccaacaucuggcucaagcugaaggagcgccaggacguguucugcgacagcaagcugauguccgccgccaucaaggacaaccgggcggugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgccggcccggugagccagcacaacuaccgccccggguaccacacccagacggcgggccccuggcaccucgggaagcuggagauggacuucgacuucugcgagggcaccaccgucguggugaccgaggacugcgggaaccggggccccagccugcgcacgaccaccgccuccggcaagcucaucaccgaguggugcugccggagcugcacgcugccgccccugcgcuaccgcggggaggacggcugcugguacgggauggagauccgcccccucaaggagaaggaggagaaccuggucaacucccuggugaccgccggccacgggcagaucgacaacuucagccucggcgugcugggcauggcccuguuccucgaggagaugcugcggacccgcgucgggaccaagcacgcggugcugcucguggccgucuccuucaugacgcugaucaccggcaacaugagcuuccgggaccuggggcgcgugauggugauggucggcgccgccaugaccgacgacaucgggaugggcgugaccuaccucgcccugcuggcggccuucaaggugcgccccacguucgccgccggccuccugcugcggaagcucaccuccaaggagcugaugaugaccaccaucgggaucguccugcucagccaguccacgaucccggagaccauccuggagcugaccgacgcccucgcgcugggcaugaugauccugaagaucgugcgcaacauggagaaguaccagcucgccgucaccaucauggccauccugugcgugcccaacgccgugauccugcagaacgccuggaaggucagcugcacgauccucgcggugguguccgucagcccccugcugcucaccuccagccagcagaaggccgacuggaucccccuggcccugaccaucaaggggcucaacccgaccgccaucuuccugacgacccugucccggaccaacaagaagcgcagcuggccccucaacgaggcgaucauggccgugggcaugguguccauccuggccagcucccugcucaagaacgacauccccaugaccggcccccuggucgccgggggccugcucacggugugcuacgugcugaccgggcggagcgccgaccuggagcucgagcgcgcggccgacguccggugggaggaccaggccgagaucagcggcuccagcccgauccuguccaucaccaucagcgaggacggguccaugagcaucaagaacgaggaggaggagcagacccugacgauccucauccgcaccggccugcuggugaucuccggccucuuccccgugagcauccccaucaccgccgccgcgugguaccugugggaggucaagaagcagcgggccggggugcugugggacgugcccuccccgccgcccgucggcaaggccgagcucgaggacggggccuaccgcaucaagcagaagggcauccugggguacagccagaucggcgccggcguguacaaggaggggaccuuccacaccauguggcacgugacgcggggcgcgguccugaugcacaaggggaagcgcaucgagccguccugggccgacgugcggaaggaccucaucagcuacggcgggggcuggaagcuggagggcgaguggaaggagggggaggaggugcagguccuggcccucgagcccggcaagaacccccgcgccgugcagaccaagcccgggcuguucaagaccaacaccggcacgaucggggccgugucccuggacuucagcccgggcaccuccggcagccccaucgucgacaagaaggggaagguggugggccucuacgggaacggcgucgugacccgguccggcaccuacgugagcgcgaucgcccagacggagaaguccaucgaggacaaccccgagaucgaggacgacaucuuccgcaagaagcggcugaccaucauggaccugcaccccggggccggcaagaccaagcgcuaccugccggccaucguccgggaggcgaucaagcgcgggcuccggacccugauccuggcccccacgcgcgugguggccgccgagauggaggaggcccuccgcggccugcccauccgguaccagacccccgcgauccgcgccgagcacaccgggcgggagaucgucgaccugaugugccacgccaccuucacgaugcgccuccugagcccggugcgggugcccaacuacaaccugaucaucauggacgaggcccacuucaccgaccccgccagcaucgcggcccgcggcuacaucuccacccgggucgagaugggcgaggccgccgggaucuucaugaccgccacgcccccgggcagccgcgaccccuucccccaguccaacgcgcccaucauggacgaggagcgggagaucccggagcgcagcuggaacuccgggcacgagugggugaccgacuucaagggcaagaccgugugguucguccccagcaucaaggccgggaacgacaucgccgccugccuccggaagaacggcaagaaggugauccagcugucccgcaagaccuucgacagcgaguacaucaagacgcggaccaacgacugggacuucguggucaccaccgacaucuccgagaugggcgcgaacuucaaggccgagcgcgugaucgacccccggcgcugcaugaagcccgugauccugacggacggggaggagcgggucauccucgccggcccgaugcccgugacccacagcuccgccgcccagcgccgggggcgcaucggccgcaaccccaagaacgagaacgaccaguacaucuacaugggggagccccuggagaacgacgaggacugcgcgcacuggaaggaggccaagaugcugcucgacaacaucaacaccccggagggcaucauccccagcauguucgagcccgagcgggagaagguggacgccaucgacggcgaguaccgccugcgcggggaggcccgcaagaccuucgucgaccugaugcggcgcggcgaccucccgguguggcuggccuaccgggucgcggccgaggggaucaacuacgccgaccgccgguggugcuucgacggcaucaagaacaaccagauccuggaggagaacguggagguggagaucuggacgaaggagggggagcgcaagaagcucaagccccgguggcuggacgcccgcaucuacuccgacccccuggcccucaaggaguucaaggaguucgcggccggccgcaagagccugacccugaaccucaucaccgagaugggccgccugcccaccuucaugacgcagaaggcccggaacgcccuggacaaccucgcgguccugcacaccgccgaggccgggggccgcgccuacaaccacgcccuguccgagcucccggagacccuggagacccugcuccugcugacgcuccuggcgaccgugaccgggggcaucuuccuguuccucaugagcggcaaggggaucggcaagaugacccuggggaugugcugcaucaucaccgccuccauccugcucugguacgcccagauccagccccacuggaucgccgccagcaucauccuggaguucuuccugaucgugcuccugauccccgagcccgagaagcagcggacgccgcaggacaaccagcugaccuacgucgugaucgcgauccucaccguggucgccgccaccauggccaacgagaugggcuuccuggagaagacgaagaaggacuucgggcugggcuccaucgccacccagcagcccgagagcaacauccucgacaucgaccugcgccccgcgagcgccuggacccuguacgccguggccaccacguucaucacccccaugcuccggcacuccaucgagaacagcuccgugaacgucagccugaccgccaucgcgaaccaggccaccgugcugaugggccucgggaagggcuggccgcuguccaagauggacaucggggugccccugcucgccaucggcugcuacagccaggucaaccccaucacgcugaccgccgcgcugcuccugcugguggcccacuacgccaucaucgggcccggccuccaggccaaggccacccgcgaggcgcagaagcgggccgccgccggcaucaugaagaacccgaccguggacgggaucacggucaucgaccuggaccccauccccuacgaccccaaguucgagaagcagcugggccaggugaugcuccuggugcugugcgucacccaggugcucaugaugcgcaccaccugggcccugugcgaggcgcugacgcucgccaccgggccgaucuccacccugugggagggcaaccccgggcgcuucuggaacaccacgaucgccgugagcauggccaacaucuuccggggcuccuaccuggccggcgcggggcuccuguucagcaucaugaagaacaccaccaacacccgccggggcacggggaacaccggcgagacccugggcgagaaguggaagaaccgccucaacucccugggcaagagcgaguuccagaucuacaagcgguccggcauccaggaggucgaccgcacccuggccaaggaggggaucaagcggggcgagacggaccaccacgccgugagccgcggguccgccaagcuccggugguucguggagcgcaaccuggucacccccgagggcaaggugguggaccugggcugcgggcggggcggguggagcuacuacugcggcgggcucaagaacguccgcgaggugaagggccugaccaagggcgggcccggccacgaggagccgauccccauguccaccuacggguggaaccuggugcggcuccagagcggcgucgacguguucuucacgccgcccgagaagugcgacacccugcugugcgacaucggggaguccagcccgaaccccaccguggaggcgggccgcacccuccggguccugaaccugguggagaacuggcucaacaacaacacccaguucugcaucaaggugcugaaccccuacaugccgagcgucaucgagaagauggagacgcugcagcgcaaguacggcggggcccuggugcggaacccccucucccgcaacagcacccacgagauguacuggguguccaacgccagcggcaacaucgucuccagcgugaacaugaucucccggaugcugaucaaccgcuucaccaugcgccacaagaaggccaccuacgagcccgacguggaccuggggagcggcacgcggaacaucgggaucgaguccgagacccccaaccucgacaucaucggcaagcgcaucgagaagaucaagcaggagcacgagaccagcuggcacuacgaccaggaccacccguacaagaccugggccuaccacggcuccuacgagacgaagcagaccgggagcgcguccagcauggucaacggcguggugcggcugcugaccaagcccugggacgucauccccauggugacccagauggccaugacggacaccacccccuucgggcagcagcgcguguucaaggagaaggucgacacccggacgcaggagccgaaggagggcaccaagaagcucaugaagaucaccgccgaguggcuguggaaggagcugggcaagaagaagacgccccggaugugcacgcgggaggaguucacccgcaaggugcgguccaacgccgcccucggggcgaucuucaccgacgagaacaaguggaaguccgcccgcgaggccgucgaggacucccgguucugggagcugguggacaaggagcgcaaccugcaccucgagggcaagugcgagaccugcguguacaacaugauggggaagcgggagaagaagaucggcgaguucgggaaggccaagggcagccgcgccaucugguacauguggcugggcgcgcgguuccuggaguucgaggcccucggguuccugaacgaggaccacugguucucccgcgagaacagccugagcggcgucgagggggagggccuccacaagcugggguacauccugcgggagguguccaagaaggagggcggcgccauguacgccgacgacacggcggggugggacacccgcaucacccucgaggaccugaagaacgaggagauggugaccaaccacauggagggcgagcacaagaagcuggccgaggccaucuucaagcucacguaccagaacaaggucgugcgggugcagcgccccacgccccgggggaccgucauggacaucaucagccgccgcgaccagcggggcuccggccagguggggaccuacggccugaacacguucaccaacaugggggcccagcugauccgccagauggagggcgaggggguguucaagggcauccagcaccucaccgccaccgaggaggucgcggugcaggacuggcuggcccgggugggccgcgagcggcugagccgcauggccaucuccggggacgacugcgucgugaagccgcucgacgaccgguucgccagcgcccugacggcgcugaacgacaugggcaagauccgcaaggacauccagcagugggagcccucccggggguggaacgacuggacccaggugcccuucugcagccaccacuuccacgagcucaucaugaaggacggccgcguccugguggugcccugccggaaccaggacgagcugaucgggcgcgcccggaucucccagggcgccggcuggagccuccgcgagaccgccugccuggggaaguccuacgcccagauguggagccugauguacuuccaccggcgcgaccuccggcuggcggccaacgccaucugcuccgccgucccgagccacugggugcccaccucccgcaccacguggagcauccacgcccggcacgaguggaugaccaccgaggacaugcugaccguguggaaccgcgucuggauccaggagaaccccuggauggaggacaagacgcccguggaguccugggaggagaucccguaccucggcaagcgcgaggaccaguggugcgggagccugaucggccugaccagccgggcgaccugggccaagaacauccagaccgccaucaaccaggugcgcucccucaucgggagcgaggaguacacggacuacaugcccuccaugaagcgguuccgccgggaggaggaggaggccggcguccugugguga

SEQ ID NO: 9645 - RNA, 9876 nt, Artificial Sequence
  derived and/or modified CDS sequence (opt1) from DENV-2__JX470186__SS-prME
accgcgggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccacccgggguucaccaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggcgcaccggcagugguuccucgaccugccccugcccuggcucccgggcgccgacacccagggguccaacuggauccagaaggagacccuggugacguucaagaacccccacgccaagaagcaggacgucgugguccugggcagccaggagggggccaugcacaccgcccucaccggcgcgaccgagauccagaugagcuccgggaaccugcuguucacgggccaccucaagugccgccugcggauggacaagcugcagcucaagggcaugagcuacuccaugugcaccgggaaguucaagguggugaaggagaucgccgagacccagcacggcaccaucgucauccgcgugcaguacgagggggacggcagccccugcaagauccccuucgagaucauggaccuggagaagcggcacgugcugggccgccucaucacggucaacccgaucgugaccgagaaggacucccccgugaacaucgaggccgagccgcccuucggggacagcuacaucaucaucggcgucgagccggggcagcugaagcuguccugguucaagaagggcagcuccaucgggcagauguucgagaccaccaugcgcggcgccaagcggauggccauccucggcgacacggcgugggacuucgggagccugggcgggguguucaccuccaucggcaaggcccugcaccagguguucggggccaucuacggcgccgcguucagcggcgucuccuggaccaugaagauccucaucgggguggugaucaccuggaucggcaugaacagccgcuccacgagccuguccgucagccuggugcuggugggggucgugacccucuaccugggcgugaugguccaggccgacuccgggugcguggugagcuggaagaacaaggagcugaagugcggcagcggcaucuucaucaccgacaacguccacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggugaagcugaccaucaugacgggggacaucaagggcaucaugcaggcggggaagcggagccuccgcccgcagcccaccgagcugaaguacuccuggaaggccuggggcaaggccaagaugcugagcaccgagcuccacaaccacaccuuccugaucgacggccccgagacggccgagugcccgaacaccaaccgggccuggaacucccuggaggucgaggacuacggguucggcguguucaccaccaacaucuggcucaagaugaaggagcgccaggacguguucugcgacagcaagcugauguccgcggccaucaaggacagccgggccguccacgccgacaugggguacuggaucgaguccgcccugaacgacacguggaagaucgagaaggcgagcuucaucgaggugaaguccugccacuggcccaagagccacacccucugguccaacggcgugcuggagagcgagaugaucauccccaagaacuucgccggccccgucagccagcacaacuaccgcccgggguaccacacccagaccgccggccccuggcaccuggggcggcucgagauggacuucgacuucugcgagggcaccacggugguggucaccgaggacugcgggaaccgcggccccucccugcggaccaccacggccagcggcaagcugaucaccgaguggugcugccgcuccugcacccugccgccccugcgguaccgcggggaggacggcugcugguacgggauggagauccggccccugaaggagaaggaggagaaccucgugaacagccuggugaccgcgggccacgggcagaucgacaacuucucccugggcguccucggcauggcccuguuccuggaggagaugcuccgcacgcggguggggaccaagcacgccauccugcugguggccgucagcuucgugacccucaucaccggcaacauguccuuccgcgaccuggggcgcgugauggucauggugggcgccacgaugaccgacgacaucgggaugggcgugaccuaccuggcgcuccuggccgccuucaagguccggcccaccuucgccgccggccugcuccugcgcaagcugacgagcaaggagcucaugaugaccaccaucgggaucgugcugcugucccaggcgaccauccccgagacgauccucgagcugaccgacgcccuggcccucggcaugauggugcugaagaucguccggaacauggagaaguaccagcuggccgugaccaucauggccauccucugcguccccaacgcggugauccugcagaacgccuggaaggugagcugcaccacgcuggccgucguguccgugagcccccuccugcugaccuccagccagcagaaggccgacuggaucccccucgcgcugaccaucaaggggcugaaccccaccgccaucuuccucacgacccugucccgcaccaacaagaagcggagcuggccgcugaacgaggccaucauggccgucggcaugguguccauccucgccagcucccugcugaagaacgacauccccaugaccggcccccucguggccggcgggcugcugacggucugcuacgugcucaccgggcgcagcgccgaccuggagcuggagcgggccgccgacgugcgcugggaggagcaggccgagaucagcggguccagccccauccucuccaucaccaucagcgaggacggguccaugagcaucaagaacgaggaggaggagcagacccugacgauccugauccggaccggccuccuggucguguccggccuguucccggugagcacccccaucaccgcggccgccugguaccucugggaggucaagaagcagcgcgccggggugcugugggacgugcccagcccgccgcccgucggcaaggccgagcuggaggacggggcguaccggaucaagcagaagggcauccucggguacagccagaucggcgccggcguguacaaggaggggaccuuccacacgauguggcacgugacccgcggcgccguccugaugcacaaggggaagcggaucgagcccuccugggccgacgugaagaaggaccugaucagcuacggcgggggcuggaagcucgagggcgaguggaaggagggggaggaggugcagguccuggcccuggagcccggcaagaacccccgcgcggugcagaccaagcccggccucuucaagaccaacacgggcaccaucggggccgugucccuggacuucagccccggcaccuccggcagccccaucgucgacaagaaggggaagguggugggccuguacgggaacggcgucgugacccgguccggcacguacgugagcgccaucgcccagaccgagaaguccaucgaggacaaccccgagaucgaggacgacaucuuccgcaagaagcggcucaccaucauggaccugcaccccggggcgggcaagaccaagcgcuaccugcccgccaucguccgggaggccaucaagcgcgggcugcggacgcucauccuggccccgacccgcgugguggccgcggagauggaggaggcccugcgcggccuccccauccgguaccagacccccgccauccgcgccgagcacaccgggcgggagaucgucgaccugaugugccacgccacguucaccaugcgccugcucagccccauccgggugccgaacuacaaccugaucaucauggacgaggcgcacuucaccgaccccgccagcaucgccgcccgcggcuacaucuccacccggguggagaugggcgaggccgcggggaucuucaugacggccacgccgcccggcagccgcgacccguucccccaguccaacgcccccaucauggacgaggagcgggagauccccgagcgcagcuggaacuccgggcacgagugggucaccgacuucaagggcaagaccgugugguucgugccgagcaucaaggccgggaacgacaucgcggccugccugcggaagaacggcaagaaggucauccagcucucccgcaagacguucgacagcgaguacaucaagacccggaccaacgacugggacuucguggugaccacggacaucuccgagaugggcgccaacuucaaggccgagcgcgucaucgacccccggcgcugcaugaagcccgugauccugaccgacggggaggagcgggugauccuggccggccccaugccggucacccacagcuccgcggcccagcgccgggggcgcgugggccgcaaccccaagaacgagaacgaccaguacaucuacaugggggagccccucgagaacgacgaggacugcgcccacuggaaggaggccaagaugcugcuggacaacaucaacacccccgagggcaucaucccgagcauguucgagcccgagcgggagaagguggacgccaucgacggcgaguaccgccuccgcggggaggcgcgcaagacguucgucgaccugaugcggcgcggcgaccugcccguguggcucgccuaccgggucgccgccgaggggaucaacuacgccgaccgccgguggugcuucgacggcgugaagaacaaccagauccuggaggagaacguggaggucgagaucuggaccaaggagggggagcgcaagaagcugaagccgcgguggcucgacgcgcgcaucuacuccgacccccuggcccugaaggaguucaaggaguucgccgccggccgcaagagccucacccugaaccugaucaccgagaugggccggcuccccacguucaugacccagaaggcgcggaacgcccuggacaaccuggccgugcuccacaccgccgaggccgggggccgcgcguacaaccacgcccuguccgagcugcccgagacccucgagacgcugcugcuccugacccugcucgccaccgugaccgggggcaucuuccuguuccugaugagcggcaaggggaucggcaagaugacccucgggaugugcugcaucaucacggccuccauccugcugugguacgcccagauccagccgcacuggaucgcggccagcaucauccucgaguucuuccugaucguccugcucauccccgagcccgagaagcagcggacgccccaggacaaccagcugaccuacguggugaucgccauccugaccgucguggccgccacgauggcgaacgagaugggcuuccucgagaagaccaagaaggacuucgggcugggcuccaucaccacccagcagccggagaacaacauccuggacaucgaccuccgccccgccagcgccuggacgcuguacgccguggccaccaccuucaucacccccaugcugcggcacagcaucgagaacuccagcgucaacgugucccucacggcgaucgccaaccaggccaccgugcugaugggccuggggaagggcuggccccucagcaagauggacaucggggucccgcugcuggccaucggcugcuacucccaggugaaccccaucacccucaccgcggcccugcugcuccugguggcccacuacgccaucaucgggcccggccugcaggccaaggcgacgcgcgaggcccagaagcgggccgccgccggcaucaugaagaaccccaccgucgacgggaucaccgugaucgaccucgacccgauccccuacgaccccaaguucgagaagcagcugggccaggugaugcugcucguccugugcgugacccaggugcugaugaugcgcacgaccugggcgcucugcgaggcccugacccuggccaccgggcccaucagcacgcucugggagggcaacccggggcgcuucuggaacaccaccaucgccgucuccauggccaacaucuuccggggcagcuaccuggcgggcgccgggcuccucuucuccaucaugaagaacaccgccaacacgcgccggggcaccgggaacaccggcgagacccugggcgagaaguggaagaaccgccugaacgcccucgggaaguccgaguuccagaucuacaagaaguccggcauccaggagguggaccggacgcuggcgaaggaggggaucaagcgcggcgagaccgaccaccacgccgugagccggggguccgccaagcugcgcugguucgucgagcggaaccucgugacccccgagggcaagguggucgaccugggcugcgggcgcggcggguggagcuacuacugcggcgggcugaagaacgugaaggaggugaagggccucaccaagggcgggcccggccacgaggagcccaucccgauguccacguacggguggaaccugguccggcugcagagcggcguggacguguucuucacgccgcccgagaagugcgacacccuccugugcgacaucggggaguccagccccaacccgaccgucgaggccggccgcacccugcgggugcucaaccugguggagaacuggcugaacaacaacacgcaguucugcaucaagguccucaaccccuacaugcccuccgugaucgagaagauggaggcccugcagcgcaaguacggcggggcgcuggugcggaacccgcugagccgcaacagcacccacgagauguacugggucuccaacgccagcggcaacaucguguccagcgugaacaugaucucccggaugcucaucaaccgcuucaccaugcggcacaagaaggccaccuacgagcccgacgucgaccuggggagcggcacgcgcaacaucgggaucgaguccgagacccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgugguccggcuccugaccaagccgugggacgugauccccauggugacccagauggcgaugacggacaccacccccuucgggcagcagcgcgucuucaaggagaagguggacacccggacgcaggagcccaaggagggcaccaagaagcugaugaagaucaccgccgaguggcucuggaaggagcugggcaagaagaagaccccgcgcaugugcacgcgggaggaguucacccgcaagguccgguccaacgccgcccugggggccaucuucaccgacgagaacaaguggaaguccgcgcgcgaggccguggaggacuccggcuucugggagcucguggacaaggagcggaaccugcaccuggaggggaagugcgagaccugcgucuacaacaugaugggcaagcgcgagaagaagcucggggaguucggcaaggccaagggcagccgggccaucugguacauguggcugggggcgcgcuuccuggaguucgaggcccucggcuuccugaacgaggaccacugguucucccgggagaacagccuguccgggguggagggcgaggggcuccacaagcugggcuacauccugcgcgacgugagcaagaaggagggcggggccauguacgccgacgacacggccggcugggacacccggaucacccucgaggaccugaagaacgaggagauggucaccaaccacauggagggggagcacaagaagcuggcggaggccaucuucaagcucacguaccagaacaagguggugcgcguccagcggcccacgccccgcggcaccgugauggacaucaucagccggcgcgaccagcggggguccggccagguggucaccuacggccugaacaccuucaccaacauggaggcccagcugauccgccagauggagggggagggcguguucaagagcauccagcagcucaccgugaccgaggagaucgccgucaagaacuggcuggugcgcguggggcgggagcgccugucccggauggccaucagcggcgacgacugcgucgugaagccccucgacgaccgcuucgcguccgcccugacggcccugaacgacaugggcaaggugcggaaggacauccagcagugggagccgagccgcggguggaacgacuggacccagguccccuucugcucccaccacuuccacgagcucaucaugaaggacggccgggugcuggugguccccugccgcaaccaggacgagcugaucgggcgggcccgcaucagccagggcgccggguggucccuccgggagaccgcgugccugggcaagagcuacgcccagauguggucccugauguacuuccaccgccgggaccuccgccuggccgccaacgccaucugcagcgcggugcccucccacugggugccgaccagccggaccacgugguccauccacgccacccacgaguggaugaccaccgaggacaugcugacggucuggaaccgcguguggauccaggagaaccccuggauggaggacaagacccccguggagagcugggaggagauccccuaccucggcaagcgggaggaccaguggugcgggucccugaucggccugaccagccgcgccaccugggccaagaacauccagacggcgaucaaccagguccggagccucaucgggaacgaggaguacaccgacuacaugccguccaugaagcgcuuccgccgggaggaggaggaggccggcgugcugugguga

SEQ ID NO: 9646 - RNA, 9876 nt, Artificial Sequence
  derived and/or modified CDS sequence (opt1) from DENV-2__KU517846__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccaccuacuuccagcgggugcugaucuucauccuccugaccgccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggaucgugacccucuaccugggcgugaugguccaggcggacuccgggugcguggugagcuggaagaacaaggagcugaagugcggcagcggcaucuucaucaccgacaacguccacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggugaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggaggucgaggacuacggguucggcguguucaccaccaacaucuggcucaagcugaaggagcgccaggacguguucugcgacagcaagcugauguccgccgcgaucaaggacaaccgggccguccacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcaccacggugguggucaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggugaacucccuggugaccgccggccacgggcagaucgacaacuucagccucggcguccugggcauggcgcuguuccucgaggagaugcugcgcacgcggguggggaccaagcacgccauccugcucguggccgucuccuucaugacccugaucaccggcaacaugagcuuccgcgaccuggggcgcgugauggugauggucggcgccacgaugaccgacgacaucgggaugggcgugaccuaccucgcccugcuggcggccuucaaggugcggcccaccuucgccgccggccuccugcugcgcaagcucacguccaaggagcugaugaugaccaccaucgggaucguccugcucagccaguccaccauccccgagacgauccuggagcugaccgacgcccucgcgcugggcaugauggugcugaagaucgugcggaacauggagaaguaccagcucgccgucaccaucauggccauccugugcgugccgaacgccgucauccugcagaacgccuggaaggugagcugcaccauccucgcgguggucuccgugagcccccugcugcucacguccagccagcagaaggccgacuggaucccccuggcccugaccaucaaggggcucaaccccaccgccaucuuccugaccacgcugucccgcaccagcaagaagcgguccuggccgcucaacgaggcgaucauggccgugggcauggucagcauccuggccuccagccugcucaagaacgacauccccaugaccggcccccugguggccgggggccugcucaccgugugcuacguccugacggggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcugacccucaccauccugauccggacgggccugcucgugaucagcggccuguucccggucuccauccccaucaccgccgccgcgugguaccugugggaggugaagaagcagcgcgccggggugcucugggacguccccagcccgccgcccgugggcaaggccgagcuggaggacggggccuaccggaucaagcagaagggcauccugggguacucccagaucggcgccggcguguacaaggaggggaccuuccacaccauguggcacgucacccgcggcgcggugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccccgcgccgugcagacgaagcccgggcuguucaagaccaacaccggcaccaucggggccgucagccucgacuucucccccggcacgagcggcucccccaucguggacaagaaggggaagguggucggccuguacgggaacggcguggugacccggagcggcaccuacgucuccgcgaucgcccagaccgagaaguccaucgaggacaaccccgagaucgaggacgacaucuuccgcaagaagcggcugacgaucauggaccugcaccccggggccggcaagaccaagcgcuaccuccccgccaucgugcgggaggcgaucaagcgcgggcugcggacccugauccucgccccgacccgcguggucgccgccgagauggaggaggcccugcgcggccugcccauccgguaccagacgcccgcgauccgcgccgagcacaccgggcgggagaucguggaccucaugugccacgccaccuucaccaugcgccugcugagccccauccgggugccgaacuacaaccucaucaucauggacgaggcccacuucacggaccccgccuccaucgcggcccgcggcuacaucagcacccgggucgagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugacggacuucaagggcaagaccgugugguucgucccguccaucaaggccgggaacgacaucgccgccugccugcggaagaacggcaagaaggugauccagcugagccgcaagaccuucgacuccgaguacaucaagacccggacgaacgacugggacuucguggucaccaccgacaucagcgagaugggcgcgaacuucaaggccgagcgcgugaucgacccccggcgcugcaugaagcccgugauccucaccgacggggaggagcgggucauccuggccggccccaugccggugacgcacuccagcgccgcccagcgccgggggcgcgugggccgcaaccccaagaacgagaacgaccaguacaucuacaugggggagccccuggagaacgacgaggacugcgcgcacuggaaggaggccaagaugcuccuggacaacaucaacacccccgagggcaucaucccguccauguucgagcccgagcgggagaaggucgacgccaucgacggcgaguaccgccugcgcggggaggcccgcaagaccuucguggaccucaugcggcgcggcgaccugcccguguggcuggccuaccgggucgcggccgaggggaucaacuacgccgaccgccgguggugcuucgacggcgugaagaacaaccagauccucgaggagaacgucgagguggagaucuggaccaaggagggggagcgcaagaagcugaagccgcgguggcuggacgcccgcaucuacagcgacccccucgcccugaaggaguucaaggaguucgcggccggccggaagucccugacgcucaaccugaucaccgagaugggccgccugcccaccuucaugacccagaaggcccggaacgcccucgacaaccuggcggugcugcacacggccgaggccgggggccgcgccuacaaccacgcccucagcgagcugcccgagacccuggagacccuccugcugcucacccugcuggcgacggucaccgggggcaucuuccucuuccugauguccggcaaggggaucggcaagaugacccuggggaugugcugcaucaucaccgccagcauccuccugugguacgcccagauccagccgcacuggaucgccgccuccaucauccuggaguucuuccucaucgugcugcugauccccgagcccgagaagcagcggacgccccaggacaaccagcucacguacguggucaucgcgauccugaccgugguggccgccaccauggccaacgagaugggcuuccuggagaagaccaagaaggacuucgggcucggcagcaucacgacccagcagccggagagcaacauccuggacaucgaccugcgccccgccuccgcguggacccucuacgccgucgccaccacguucaucacccccaugcugcggcacagcaucgagaacuccagcgugaacgugucccugaccgccaucgccaaccaggcgaccguccucaugggccuggggaagggcuggccccugagcaagauggacaucggggugccgcuccuggccaucggcugcuacucccaggugaaccccaucacgcugaccgccgcccuccugcugcucgucgcgcacuacgccaucaucgggcccggccugcaggccaaggccacccgcgaggcccagaagcgggcggccgccggcaucaugaagaaccccaccguggacgggaucacggugaucgaccuggacccgauccccuacgaccccaaguucgagaagcagcucggccaggucaugcugcuggugcucugcgugacccagguccugaugaugcgcaccaccugggcccugugcgaggcccucacgcuggcgaccgggcccaucagcacccugugggagggcaacccggggcgcuucuggaacaccacgaucgccguguccauggccaacaucuuccggggcagcuaccucgccggcgccgggcugcuguucuccaucaugaagaacaccgcgaacacccgccggggcaccgggaacacgggcgagacccucggcgagaaguggaagaaccgccugaacgcccugggcaagagcgaguuccagaucuacaagaaguccggcauccaggagguggaccggacccucgccaaggaggggaucaagcgcggcgagaccgaccaccacgccgucagccggggguccgcgaagcugcgcugguucguggagcggaaccuggugacgcccgagggcaaggucguggaccucggcugcgggcgcggcggguggagcuacuacugcggcgggcugaagaacgugaaggaggucaagggccugaccaagggcgggcccggccacgaggagcccaucccgauguccaccuacggguggaaccucgugcggcugcagagcggcguggacgucuucuucacgccgcccgagaagugcgacacgcugcucugcgacaucggggaguccagccccaacccgaccguggaggccggccgcacccugcgggugcugaaccucgucgagaacuggcugaacaacaacacccaguucugcaucaaggugcugagccccuacaugcccuccgugaucgagaagauggaggcccugcagcgcaaguacggcggggcccucguccggaacccgcugagccgcaacuccacccacgagauguacugggugagcaacgccuccggcaacaucgugagcuccgucaacaugaucagccggaugcugaucaaccgcuucacgaugcggcacaagaaggcgaccuacgagcccgacguggaccucggguccggcacccgcaacaucgggaucgagagcgagacccccaaccuggacaucaucggcaagcgcaucgagaagaucaagcaggagcacgagacguccuggcacuacgaccaggaccaccccuacaagaccugggccuaccacggcagcuacgagaccaagcagaccggguccgccagcuccauggugaacggcgucgugcggcugcucacgaagccgugggacgugauccccauggucacccagauggccaugaccgacaccacgcccuucgggcagcagcgcguguucaaggagaagguggacacccggacccaggagcccaaggagggcaccaagaagcugaugaagaucacggccgaguggcuguggaaggagcucggcaagaagaagaccccgcgcaugugcacccgggaggaguucacccgcaagguccggagcaacgcggcccugggggccaucuucacggacgagaacaaguggaaguccgcccgcgaggccguggaggacagcggcuucugggagcuggucgacaaggagcggaaccuccaccuggaggggaagugcgagaccugcguguacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggagaacagccuguccgggguggagggcgaggggcugcacaagcucggcuacauccugcgcgacgucagcaagaaggagggcggggcgauguacgccgacgacaccgccggcugggacacccggaucacgcuggaggaccucaagaacgaggagauggugaccaaccacauggagggggagcacaagaagcuggccgaggccaucuuccgccugaccuaccagaacaaggugguccgggugcagcgccccacgccccggggcacggugauggacaucaucucccgccgggaccagcgcgggagcggccaggucgugaccuacggccucaacaccuucaccaacauggaggcgcagcugauccgccagauggagggggagggcguguucaaguccauccagcaccugacggucaccgaggagaucgccgugaagaacuggcucgagcggguggggcgcgagcggcugagccgcauggccaucuccggcgacgacugcgucgugaagccccuggacgaccgguucgccagcgcccucaccgcgcugaacgacaugggcaagauccgcaaggacauccagcagugggagccgucccggggguggaacgacuggacccaggugcccuucugcagccaccacuuccacgagcugaucaugaaggacggccgcguccucguggugcccugccggaaccaggacgagcugaucgggcgcgcccggaucucccagggcgccggguggagccugcgcgagacggccugccucggcaaguccuacgcccagauguggagccugauguacuuccaccggcgcgaccugcggcucgcggccaacgccaucugcuccgccguccccagccacugggugccgaccucccgcaccaccuggagcauccacgccacccacgaguggaugacgaccgaggacaugcugaccguguggaaccgggucuggauccaggagaaccccuggauggaggacaagacccccguggagagcugggaggagauccccuaccugggcaagcgcgaggaccaguggugcgggucccucaucggccugacgagccgggcgaccugggccaagaacauccagaccgccaucaaccaggugcgcucccugaucgggaacgaggaguacaccgacuacaugccgagcaugaagcgcuuccggcgcgaggaggaggaggccggcguccucugguga

SEQ ID NO: 9647 - RNA, 9876 nt, Artificial Sequence
  derived and/or modified CDS sequence (opt1) from DENV-2__KJ830750__SS-prME
accgccggcgugaucaucaugcugauccccaccgccauggcguuccaccucaccacccggaacggggagccccacaugaucguguccaagcaggagaagggcaagucccugcuguucaagaccgaggacggggugaacaugugcacccucauggccauggaccugggcgagcugugcgaggacaccaucaccuacaacugcccccuccugcggcagaacgagcccgaggacaucgacugcuggugcaacagcaccuccaccugggugaccuacgggaccugcaccgccaccggcgagcaccgccgggagaagcggagcgucgcccuggugccccacgugggcauggggcucgagacccggaccgagaccuggauguccagcgagggcgccuggaagcacgcgcagcgcaucgagaccuggauccugcggcaccccggguucacgaucauggccgccauccuggccuacaccaucggcaccaccuacuuccagcgcguccucaucuucauccugcugacggcgguggcccccuccaugaccaugcggugcaucgggaucagcaaccgcgacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccggaaguacugcaucgaggcgaagcugaccaacacgaccaccgccagccgcugcccgacccagggggagcccucccugaacgaggagcaggacaagcgguucgugugcaagcacagcaugguggaccgcggcuggggcaacgggugcggccucuucgggaagggcgggaucgucacgugcgccauguucacgugcaagaagaacauggagggcaagaucgugcagcccgagaaccuggaguacaccaucguggucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccggaccggccucgacuucaacgagauggugcugcugcagauggagaacaaggcguggcucgugcaccgccagugguuccuggaccugccccuccccuggcugccgggcgccgacauccagggguccaacuggauccagaaggagacccuggucaccuucaagaacccccacgccaagaagcaggacguggucgugcucggcagccaggagggggccaugcacacggcccugaccggcgcgaccgagauccagaugagcuccgggaaccugcuguucaccggccaccugaagugccggcugcgcauggacaagcuccagcugaagggcaugagcuacuccaugugcacggggaaguucaagguggucaaggagaucgccgagacccagcacggcaccaucguggugcggguccaguacgagggggacggcagccccugcaagauccccuucgagaucauggaccuggagaagcgccacgugcucggccggcugaucaccgugaacccgaucgucacggggaaggacucccccgugaacaucgaggccgagccgcccuucggcgacagcuacaucaucaucgggguggagccgggccagcugaagcucuccugguucaagaaggggagcuccaucggccagauguucgagaccaccaugcgcggcgccaagcgcauggccauccugggggacaccgcgugggacuucggcagccucggcggggucuucacguccaucgggaaggcccuccaccagguguucggggccaucuacggcgccgcguucagcgggguguccuggaccaugaagauccugaucggcgucgugaucaccuggaucgggaugaacagccgguccaccagccuguccgugagccugguccucgugggcguggucacgcuguaccugggggugauggugcaggccgacuccggcugcgucgugagcuggaagaacaaggagcucaagugcggcagcgggaucuucaucaccgacaacgugcacaccuggaccgagcaguacaaguuccagcccgagucccccagcaagcuggccuccgccauccagaaggcccacgaggagggcaucugcgggauccgcagcgucacgcggcuggagaaccucauguggaagcagaucacccccgagcugaaccacauccuguccgagaacgaggugaagcucagcaucaugaccggcgacaucaaggggaucaugcaggcgggcaagcgcucccugcggccgcagcccaccgagcugaaguacagcuggaagacguggggcaaggccaagaugcucuccaccgagccccacaaccagaccuuccugaucgacgggccggagaccgccgagugccccaacacgaaccgcgccuggaacagccuggagguggaggacuacggcuucggggucuucaccaccaacaucuggcucaagcugaaggagcggcaggacguguccugcgacagcaagcugauguccgccgcgaucaaggacaaccgcgccgugcacgccgacaugggcuacuggaucgagagcgcccucaacgacaccuggaagaucgagaaggccuccuucaucgaggucaagagcugccacuggcccaagucccacacgcuguggagcaacggcgugcuggagagcgagaugaucauccccaagaacuucgcggggccggugucccagcacaacuaccggcccggcuaccacacccagaccgccgggcccuggcaccucggcaagcuggagauggacuucgacuucugcgaggggaccaccgucguggugacggaggacugcggcaaccgcggccccagccugcggaccaccaccgccuccgggaagcucaucacggaguggugcugccgcagcugcacccugccgccccugcgguaccgcggcgaggacgggugcugguacggcauggagauccggccccucaaggagaaggaggagaaccuggucaacucccuggugaccgccgggcacggccagaucgacaacuucagccucggcgugcuggggauggcgcuguuccucgaggagaugcugcgcacccgggucggcacgaagcacgccgugcugcucguggccgucuccuucaugacccugaucaccgggaacaugagcuuccgcgaccugggccgggugauggugauggucggggccgccaugaccgacgacaucggcaugggcgugacguaccucgcgcugcuggccgccuucaaggugcgccccaccuucgccgccgggcuccugcugcgcaagcucaccuccaaggagcugaugaugaccacgaucggcaucguccugcucagccaguccaccaccccggagagcauccuggagcugaccgacgcgcucgcccuggggaugaugauccugaagaucgugcggaacauggagaaguaccagcucgccgucacgaucauggccauccugugcgugcccaacgccgugauccugcagaacgcguggaaggucuccugcaccauccucgccgccgugagcgugagcccccugcugcucaccagcucccagcagaaggccgacuggaucccccuggcgcugaccaucaagggccucaacccgacggccaucuuccugaccacccugagccgcaccaacaagaagcgguccuggccccucaacgaggccaucauggccgucggcauggugagcauccuggccagcucccugcucaagaacgacauccccaugacggggccccugguggcgggcgggcugcucaccgucugcuacgugcugaccggccgcagcgccgaccuggagcucgagaaggccgccgacgugcggugggaggaccaggccgagaucuccgggagcuccccgauccugagcaucaccaucuccgaggacggcagcauguccaucaagaacgaggaggaggagcagacgcugaccauccucauccgcaccggccugcuggucaucagcggccucuuccccguguccauccccaucaccgcggccgccugguaccugugggaggugaagaagcagcgggccggcguccugugggacgugcccagcccgccgcccguggggaaggccgagcucgaggacggcgcguaccgcaucaagcagaaggggauccugggcuacucccagaucggcgccggggucuacaaggagggcacguuccacaccauguggcacgugacccgcggggccgugcugaugcacaagggcaagcgcaucgagccgagcugggccgacguccggaaggaccucaucuccuacgggggcggcuggaagcuggagggggaguggaaggagggcgaggagguccaggugcuggcccucgagcccgggaagaacccccgcgcgguccagaccaagcccggccuguucaagaccaacacggggaccaucggcgccgugagccuggacuucuccccgggcaccagcgggucccccaucguggacaagaagggcaaggucguggggcucuacggcaacggcguggucacccggagcgggacguacgugagcgccaucgcccagaccgagaaguccaucgaggacaaccccgagaucgaggacgacaucuuccgcaagaagcggcugaccaucauggaccugcaccccggcgcggggaagaccaagcgcuaccugccggccaucgugcgggaggccaucaagcgcggccuccggacgcugauccuggcccccacccgcgucguggccgcggagauggaggaggcccuccgggggcugcccauccgcuaccagacccccgccauccgcgccgagcacaccggccgggagaucguggaccugaugugccacgccacguucaccaugcgccuccugagcccgguccgggugcccaacuacaaccugaucaucauggacgaggcgcacuucaccgaccccgccuccaucgccgcccgcggcuacaucagcacccggguggagaugggggaggccgcgggcaucuucaugacggccacgccgcccgggucccgcgaccccuucccccagagcaacgcccccaucauggacgaggagcgggagauccccgagcgcuccuggaacagcggccacgagugggucaccgacuucaaggggaagaccgugugguucgugcccuccaucaaggccggcaacgacaucgcggccugccuccggaagaacggcaagaaggucauccagcugagccgcaagacguucgacuccgaguacaucaagacccggaccaacgacugggacuucguggugaccacggacaucagcgagaugggggccaacuucaaggccgagcgcgucaucgacccccggcgcugcaugaagcccgugauccugaccgacggcgaggagcgggugauccucgccgggccgaugcccgucacccacuccagcgcggcccagcgccggggccgcaucgggcggaaccccaagaacgagaacgaccaguacaucuacaugggcgagccccuggagaacgacgaggacugcgcccacuggaaggaggccaagaugcugcucgacaacaucaacaccccggagggcaucauccccuccauguucgagcccgagcgcgagaagguggacgccaucgacggggaguaccgccugcggggcgaggcgcgcaagacguucguggaccugaugcggcgcggggaccucccggucuggcuggccuaccggguggccgccgagggcaucaacuacgccgaccgccgguggugcuucgacgggaucaagaacaaccagauccuggaggagaacgucgagguggagaucuggaccaaggagggcgagcgcaagaagcucaagccccgguggcuggacgcgcgcaucuacagcgacccccuggcccucaaggaguucaaggaguucgccgccggccggaagucccugacccugaaccucaucaccgagauggggcgccugcccacguucaugacccagaaggcgcggaacgcccuggacaaccucgccgugcugcacaccgccgaggccggcgggcgcgcguacaaccacgcccugagcgagcucccggagacccuggagacgcugcuccugcugacccuccuggccaccgucaccggcggcaucuuccuguuccucauguccgggaagggcaucgggaagaugacgcugggcaugugcugcaucaucaccgccagcauccugcucugguacgcccagauccagccccacuggaucgcggccagcaucauccuggaguucuuccugaucgugcuccugauccccgagcccgagaagcagcggaccccgcaggacaaccagcugaccuacguggucaucgccauccucaccgugguggccgccacgauggcgaacgagaugggguuccuggagaagaccaagaaggacuucggccugggcuccaucgccauccagcagcccgagagcaacauccucgacaucgaccugcgccccgccuccgccuggacccuguacgccgucgcgaccacguucaucacccccaugcuccggcacagcaucgagaacuccagcgugaacgugucccugaccgccaucgccaaccaggccaccguccugauggggcucggcaagggguggccgcugagcaagauggacaucggcgugccccugcucgcgaucgggugcuacucccaggugaaccccaucacgcugaccgccgcccugcuccugcuggucgcccacuacgccaucaucggccccggccuccaggcgaaggccacccgcgaggcccagaagcgggccgccgcggggaucaugaagaacccgaccguggacggcgugacggucaucgaccuggaccccauccccuacgaccccaaguucgagaagcagcugggccaggugaugcuccuggugcugugcgucacccaggugcucaugaugcgcaccaccugggcccugugcgaggcccugacgcucgccaccggcccgaucagcacccugugggaggggaaccccggccgguucuggaacaccacgaucgccguguccauggcgaacaucuuccgcggcagcuaccuggccggggccggccuccuguucuccaucaugaagaacaccaccaacacccgccgggggacgggcaacaccggcgagacccugggggagaaguggaagaaccgccucaacagccugggcaaguccgaguuccagaucuacaagcggagcgggauccaggaggucgaccgcacccuggccaaggagggcaucaagcgcggggagacggaccaccacgcggugucccgcggcagcgccaagcuccggugguucguggagcgcaaccuggucacccccgagggcaaggugguggaccuggggugcggccgcggcgggugguccuacuacugcggcgggcucaagaacguccgcgaggugaaggggcugaccaagggcgggcccgggcacgaggagccgauccccaugagcaccuacggcuggaaccuggugcggcuccagagcggggucgacguguucuucacgccgcccgagaagugcgacacccugcugugcgacaucggcgaguccagcccgaaccccaccguggaggccggccgcacccuccggguccugaaccugguggagaacuggcucaacaacaacacgcaguucugcaucaaggugcugaaccccuacaugccguccgucaucgagaagauggagacccugcagcgcaaguacgggggcgcccuggugcggaacccccucagccgcaacuccacccacgagauguacugggugagcaacgccuccgggaacaucgucagcuccgugaacaugaucagccggaugcugaucaaccgcuucaccaugcggcacaagaaggcgaccuacgagcccgacguggaccugggcuccgggacgcgcaacaucggcaucgagagcgagacccccaaccucgacaucaucggcaagcgcaucgagaagaucaagcaggagcacgagaccuccuggcacuacgaccaggaccacccguacaagaccugggccuaccacgggagcuacgagacgaagcagaccggcuccgccagcuccauggucaacgggguggugcggcugcugaccaagcccugggacgucauccccauggugacccagauggccaugacggacaccacccccuucggccagcagcgcguguucaaggagaaggucgacacccggacgcaggagccgaaggagggcaccaagaagcucaugaagaucaccgccgaguggcuguggaaggagcuggggaagaagaagacgccccggaugugcacgcgggaggaguucgcgcgcaaggugcggagcaacgccgcccucggcgccaucuucaccgacgagaacaaguggaaguccgcccgcgaggcggucgaggacagccgguucugggagcugguggacaaggagcgcaaccugcaccucgaggggaagugcgagaccugcguguacaacaugaugggcaagcgggagaagaagaucggggaguucggcaaggccaagggcagccgcgccaucugguacauguggcugggggcccgguuccuggaguucgaggcgcucggcuuccugaacgaggaccacugguucucccgcgagaacagccuguccggggucgagggcgaggggcuccacaagcugggcuacauccugcgggaggugagcaagaaggagggcggggccauguacgccgacgacaccgccggcugggacacgcgcaucacccucgaggaccugaagaacgaggagauggugaccaaccacauggagggggagcacaagaagcuggccgaggcgaucuucaagcucaccuaccagaacaaggucgugcgggugcagcgccccacgccccggggcaccgucauggacaucaucucccgccgggaccagcgcgggagcggccaggugggcaccuacgggcugaacaccuucacgaacaugggcgcccagcugauccgccagauggagggggagggcguguucaagggcauccagcaccucaccgccaccgaggaggucgccgugcaggacuggcuggcccggguggggcgcgagcggcugucccgcauggcgaucagcggcgacgacugcgucgugaagccgcucgacgaccgguucgccuccgcccugaccgcccugaacgacauggggaaggugcgcaaggacauccagcagugggagcccagccggggcuggaacgacuggacgcagguccccuucugcucccaccacuuccacgagcucaucaugaaggacgggcgcgugcuggugguccccugccggaaccaggacgagcugaucggccgcgcccggaucagccagggcgcgggguggucccuccgcgagaccgccugccugggcaagagcuacgcccagauguggucccugauguacuuccaccggcgcgaccuccggcuggccgccaacgcgaucugcagcgccgugccgucccacugggugcccaccagccgcaccacguggagcauccacgccgggcacgaguggaugaccaccgaggacaugcugaccgucuggaaccggguguggauccaggagaaccccuggauggaggacaagacccccguggaguccugggaggagaucccguaccucggcaagcgcgaggaccaguggugcgggagccugaucggccugacgucccgggccaccugggcgcgcaacauccagaccgccaucaaccagguccgcagccucaucggcuccgaggaguacaccgacuacaugcccagcaugaagcgguuccgccgggaggaggaggaggccggggugcugugguga

SEQ ID NO: 9648 - RNA, 9876 nt, Artificial Sequence
  derived and/or modified CDS sequence (opt1) from DENV-2__FM210231__SS-prME
agcgcggggaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccggcgggagaagcgcagcgucgcccuggugccccacguggggaugggccucgagacccggaccgagaccuggauguccagcgagggggccuggaagcacgcccagcgcaucgagaccuggauccugcggcacccgggcuucaccaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccguggugcuccagaacgccuggaaggucagcugcaccauccuggcggugguguccgucagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcaugguguccauccuggccagcucccuccugaagaacgacauccccaugaccggcccccuggucgccgggggccuccugaccgugugcuacgugcugaccgggcgcagcgccgaccucgagcuggagcgggccacggacgucaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggugaagaagcagcgggccgggguccucugggacgugcccagcccgccgcccaugggcaaggcggagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcgcuggagcccggcaagaacccccgggccgugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucguccgggaggccaucaagcgcgggcugcggacccugauccucgcgccgacccgcgugguggccgccgagauggaggaggcccugcggggccugcccauccgcuaccagacccccgccaucaaggcggagcacacggggcgggagaucgucgaccucaugugccacgccaccuucaccaugcgccugcugagccccgugcgcgugccgaacuacaaccucaucaucauggacgaggcccacuucaccgaccccgccuccaucgccgcgcggggcuacaucagcacgcgcgucgagaugggcgaggccgccgggaucuucaugaccgccacgccgcccggcagccgggacccguucccccaguccaacgcccccaucaucgacgaggagcgcgagauccccgagcggagcuggaacuccgggcacgagugggugaccgacuucaagggcaagacggugugguucgucccgagcaucaaggcggggaacgacaucgccgccugccugcgcaagaacggcaagaaggugauccagcugucccggaagaccuucgacagcgaguacgugaagacccgcaccaacgacugggacuucgucgugacgaccgacaucuccgagaugggcgccaacuucaaggcggagcgggugaucgacccccgccggugcaugaagcccgucauccucaccgacggggaggagcgcgugauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaaggucgacgccaucgacggcgaguaccgccugcgcggggaggcccgcaagaccuucguggaccucaugcgccggggcgaccugcccguguggcuggccuacaaggucgccgcggaggggaucaacuacgccgaccgccgguggugcuucgacggcaucaagaacaaccagauccucgaggagaacguggaggucgagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccgugcugcacacggccgaggccggcgggcgcgccuacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgccuccauccuccugugguacgcgcagauccagccgcacuggaucgccgccagcaucauccuggaguucuuccucaucguccugcugauccccgagcccgagaagcagcgcacgccccaggacaaccagcucacguacguggugaucgccauccugaccgucguggccgcgaccauggccaacgagaugggcuuccuggagaagaccaagaaggaccucgggcugggcuccaucgugacgcagcagccggagagcaacauccuggacaucgaccuccggcccgccuccgccuggacccuguacgccgucgcgaccaccuucgugacgcccaugcugcgccacagcaucgagaacagcuccgugaacgucagccucaccgccaucgccaaccaggccaccgugcugaugggccuggggaagggcuggccccucuccaagauggacaucggggugccgcugcuggccaucggcugcuacagccaggucaaccccaucacccucacggcggcccugcugcuccugguggcccacuacgccaucaucgggcccggccugcaggcgaaggccacccgggaggcccagaagcgcgccgccgcgggcaucaugaagaaccccaccguggacgggaucaccgucaucgaccucgacccgauccccuacgaccccaaguucgagaagcagcugggccaggugaugcugcucauccugugcgugacgcagguccugaugaugcggaccaccugggcccucugcgaggcccugacccuggccacggggcccaucuccacccucugggagggcaacccggggcgcuucuggaacaccaccaucgccgugagcauggcgaacaucuuccggggcuccuaccuggccggcgccgggcuccucuucagcaucaugaagaacacgaccaacacccgccggggcaccgggaacaucggcgagacgcugggcgagaaguggaagucccgccugaacgcccucggcaagagcgaguuccagaucuacaagaaguccggcauccaggagguggaccgcacccuggccaaggaggggaucaagcggggcgagaccgaccaccacgcggucagccgcggguccgccaagcugcggugguucguggagcgcaacauggugacccccgagggcaaggucguggaccucggcugcgggcggggcggguggagcuacuacugcggcgggcugaaguccgugcgcgaggucaagggccugacgaagggcgggcccggccacgaggagcccaucccgaugagcaccuacggguggaaccucgugcggcugcaguccggcguggacgucuucuucaucccgcccgagaagugcgacacccugcucugcgacaucggggagagcucccccaacccgaccguggaggccggccgcacgcugcgggugcugaaccucgucgagaacuggcugaacaacaacacccaguucugcaucaaggugcugaaccccuacaugcccagcgugaucgagaagauggaggcccugcagcgcaaguacggcggggcgcucguccggaacccgcugagccgcaacuccacccacgagauguacugggugagcaacgccuccggcaacaucgugagcuccgucaacaugaucagccggaugcugaucaaccgcuucaccaugcggcacaagaaggccaccuacgagcccgacguggaccucggguccggcacgcgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagaccaagcagacgggguccgccagcuccauggugaacggcgucgugcgccugcucaccaagccgugggacgugcugcccaccgucacccagauggcgaugacggacaccacccccuucgggcagcagcggguguucaaggagaagguggacacccgcacgcaggagcccaaggagggcaccaagaagcugaugaagaucaccgccgaguggcucuggaaggagcugggcaagaagaagaccccgcgcaugugcacgcgggaggaguucacccgcaagguccggagcaacgccgcccugggggccaucuucaccgacgagaacaaguggaaguccgcgcgcgaggccguggaggacagccgguucugggagcucgucgacaaggagcgcaaccugcaccuggagggcaagugcgagaccugcguguacaacaugauggggaagcgggagaagaagcucggcgaguucgggaaggccaagggcucccgcgccaucugguacauguggcugggcgcccgguuccuggaguucgaggcgcucggguuccugaacgaggaccacugguucagccgcgagaacucccugagcggcguggagggggagggccuccacaagcugggguacauccugcgggacgucagcaagaaggagggcggcgccauguacgccgacgacacggccgggugggacacccgcaucacccucgaggaccugaagaacgaggagauggugaccaaccacauggagggcgagcacaagaagcuggcggaggccaucuucaagcucacguaccagaacaaggugguccgggugcagcgccccacgccccgggggaccgugauggacaucaucucccgccgggaccagcgcggcagcgggcaggucggcaccuacggccugaacacguucaccaacauggaggcccagcugauccggcagauggagggggagggcguguucaagaacauccagcaccucaccgugaccgaggaggucgccgugcagaacuggcuggcccgcguggggcgggagcgccugucccgcauggcgaucagcggcgacgacugcgucgugaagccccucgacgaccgguucgccaacgcccugacggcccugaacgacaugggcaagauccgcaaggacauccagcagugggagccguccaagggguggaacgacuggacccaggugcccuucugcagccaccacuuccacgagcucaucaugaaggacggccggguccugguggugcccugccgcaaccaggacgagcugaucgggcgggcccgcaucucccagggcgcgggguggagccuccgggagaccgccugccugggcaaguccuacgcccagauguggagccugauguacuuccaccgccgggaccuccgccuggccgccaacgcgaucugcuccgccguccccagccacugggugccgaccucccggacgaccuggagcauccacgccaagcacgaguggaugaccaccgaggacaugcugaccguguggaaccgcgucuggauccgggagaaccccuggauggaggacaagacgcccguggaguccugggaggagauccccuaccucggcaagcgcgaggaccaguggugcgggagccugaucggccugaccucccgggccaccugggccaagaacauccaggcggccaucaaccaggugcgcagccucaucgggaacgaggaguacaccgacuacaugccgagcaugaagcgguuccgccgggaggaggaggaggccggcguccugugguga

SEQ ID NO: 9649 - RNA, 9876 nt, Artificial Sequence
  derived and/or modified CDS sequence (opt1) from DENV-2__FM210239__SS-prME
accgccggcgugaucaucaugcugauccccaccgccauggcguuccaccucaccacccggaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcuccgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacccuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgacaucaaggggaucaugcaggccggcaagcggucccugcgcccccagcccaccgagcugaaguacagcuggaagaccuggggcaaggccaagaugcucuccaccgagagccacaaccagacguuccugaucgacgggccggagaccgccgagugccccaacaccaaccgggccuggaacucccuggagguggaggacuacggcuucgggguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggucaagagcugccacuggcccaagucccacacccuguggagcaacggcgugcuggaguccgagaugaucauccccaagagcuucgccgggccggugucccagcacaacuaccgccccggcuacuacacccagaccgccgggcccuggcaccucggcaagcuggagauggacuucgacuucugcgaggggacgaccguggucgugaccgaggacugcggcaaccggggccccagccugcgcaccacgaccgccagcgggaagcucaucaccgaguggugcugccgguccugcacccugccgccccugcgcuaccggggcgaggacgggugcugguacggcauggagauccgcccccucaaggagaaggaggagaaccuggugaacagccuggucacggcggggcacggccagaucgacaacuucucccucggcgugcuggggauggcccuguuccucgaggagaugcugcggacccgcgugggcaccaagcacgccauccugcucgucaccgugagcuucgugacgcugaucaccgggaacauguccuuccgggaccugggccgcgucauggugauggugggggccgccaugaccgacgacaucggcaugggcgucaccuaccucgcgcugcuggccgccuucaaggugcgccccacguucgccgccgggcuccugcugcggaagcucaccagcaaggagcugaugauggcgaccaucggcaucgcccugcucucccagagcaccaucccggagacgauccuggagcugaccgacgcccucgcccuggggaugauggugcugaagaucguccgcaacauggagaaguaccagcucgccgugaccaucauggcgaucuccugcgugcccaacgccgucauccugcagaacgccuggaaggugagcugcaccauccuggccgcgguguccgucagcccccuccugcugacguccagccagcagaaggccgacuggaucccccucgcccugaccaucaagggccugaacccgaccgccaucuuccucaccacgcugucccggaccagcaagaagcgcuccuggccccugaacgaggccaucauggcggugggcauggucagcauccucgccuccagccugcugaagaacgacauccccaugaccgggccccucguggccggcgggcugcugaccgugugcuacguccucacgggccggagcgccgaccuggagcuggagcgcgccaccgacgugaagugggaggaccaggcggagaucuccgggagcuccccgauccucagcaucaccaucgccgaggacggcuccaugagcaucaagaacgaggaggaggagcagacccugacgauccugauccggaccggccuccuggugaucuccgggcuguuccccgucagcauccccaucaccgccgccgccugguaccucugggaggugaagaagcagcgcgcgggcgugcugugggacguccccuccccgccgcccguggggaaggccgagcuggaggacggcgccuaccggaucaagcagaaggggauccucggcuacagccagaucggcgccgggguguacaaggagggcaccuuccacaccauguggcacgucacgcgcggggccgugcugaugcaccggggcaagcgcaucgagccguccugggcggacgugaagaaggaccugaucagcuacgggggcggcuggaagcucgagggggaguggaaggagggcgaggagguccaggugcuggcccuggagcccgggaagaacccccgggccgugcagaccaagcccggccucuucaagaccaacaccgggacgaucggcgccgucucccuggacuucagcccgggcaccuccgggagccccaucguggaccgcaagggcaagguggucgggcuguacggcaacggcguggugacccgguccggggcguacgucagcgccaucgcccagaccgagaaguccaucgaggacaaccccgagaucgaggacgacaucuuccgcaagaagcggcucacgaucauggaccugcaccccggcgccgggaagaccaagcgcuaccugccggccaucgugcgggaggcgaucaagcgcggccugcggacccucauccuggcccccacccgcguggucgccgccgagauggaggaggcccugcgcgggcuccccauccgguaccagacgcccgcgauccgcgccgagcacaccggccgggagaucguggaccugaugugccacgccaccuucaccaugcgccugcucagcccggugcggguccccaacuacaaccugaucaucauggacgaggcccacuucacggaccccgccagcaucgcggcccgcggcuacaucuccacccggguggagaugggggaggccgccggcaucuucaugaccgcgacgccgcccgggagccgcgaccccuucccccaguccaacgcccccaucauggacgaggagcgggagauccccgagcgcagcuggaacuccggccacgagugggugacggacuucaaggggaagaccgucugguucgugcccagcaucaaggccggcaacgacaucgccgccugccugcggaagaacggcaagaaggugauccagcucucccgcaagaccuucgacagcgaguacgucaagacccggacgaacgacugggacuucguggugaccaccgacaucuccgagaugggggcgaacuucaaggccgagcgcgucaucgacccccggcgcugcaugaagcccgugauccugaccgacggcgaggagcgggugauccuggccgggccgaugcccgucacgcacagcuccgccgcccagcgccggggccgcaucgggcgcaaccccaagaacgagaacgaccaguacaucuacaugggcgagccccucgagaacgacgaggacugcgcgcacuggaaggaggccaagaugcugcuggacaacaucaacaccccggagggcaucauccccagcauguucgagcccgagcgggagaagguggacgccaucgacggggaguaccgccuccggggcgaggcccgccggaccuucguggaccugaugcgccgcggggaccugccggucuggcucgccuaccgcguggcggccgagggcaucaacuacgccgaccggcgcuggugcuucgacggggugaagaacaaccagauccuggaggagaacgucgagguggagaucuggaccaaggagggcgagcggaagaagcugaagccccgcuggcucgacgcccggaucuacuccgacccccuggcgcugaaggaguucaaggaguucgccgccggccgcaagagccucacgcugaaccugaucaccgagauggggcggcuccccaccuucaugacccagaaggcccgcgacgcccuggacaaccuggcggugcuccacacggccgaggccggcgggcgggccuacaaccacgcccuguccgagcugccggagacccucgagacccugcugcuccugacccugcucgcgacggucaccggcggcaucuuccuguuccugaugagcgggaagggcguggggaagaugacccucggcaugugcugcaucaucaccgccuccauccugcugugguacgcccagauccagccccacuggaucgccgccagcaucauccucgaguucuuccugaucguccugcucauccccgagcccgagaagcagcgcaccccgcaggacaaccagcugacguacguggugaucgcgauccugaccgucguggccgccaccauggccaacgagaugggguuccucgagaagaccaagaaggaccugggccugggcuccaucgccacgcaggagcccgagagcaacauccucgacaucgaccugcggcccgcgagcgccuggacccuguacgccguggccaccaccuucgucacgcccaugcuccgccacuccaucgagaacagcuccgugaacgugagccugaccgcgaucgccaaccaggccaccguccugauggggcucggcaagggguggccgcuguccaagauggacaucggcgugccccugcucgccaucgggugcuacagccaggugaaccccaucacccugacggccgcgcugcuccugcuggucgcccacuacgccaucaucggccccggccuccaggccaaggccacccgggaggcgcagaagcgcgccgccgccgggaucaugaagaacccgaccguggacggcgugaccgucaucgaccuggaccccauccccuacgaccccaaguucgagaagcagcugggccaggugaugcuccugauccugugcgugacgcagguccucaugaugcgcaccaccugggcccugugcgaggcgcugacccucgccacgggcccgaucuccacccugugggaggggaaccccggccgguucuggaacaccaccaucgccgugagcauggccaacaucuuccgcggcuccuaccuggcgggggccggccuccuguucagcaucaugaagaacacgaccaacacccggcgcgggaccggcaacaucggcgagacgcugggggagaaguggaagucccggcucaacgcccugggcaagagcgaguuccagaucuacaagaaguccgggauccaggagguggaccgcacccuggccaaggagggcaucaagcgcggggagaccgaccaccacgccgucagccgcggcuccgcgaagcuccggugguucguggagcgcaacauggugacccccgagggcaaggucguggaccuggggugcggccgcggcggguggagcuacuacugcggcgggcugaaggacgugcgcgaggucaaggggcucacgaagggcggccccgggcacgaggagccgauccccauguccaccuacggcuggaaccuggugcggcugcagagcgggguggacgucuucuucacgccgcccgagaagugcgacacccuccugugcgacaucggcgaguccagcccgaaccccacgaucgaggccggccgcacccugcgggugcucagccugguggagaacuggcugaacaacgacacccaguucugcaucaagguccucaaccccuacaugccguccgugaucgagaagauggagacccugcagcgcaaguacgggggcgcccuggugcggaacccccugagccgcaacuccacccacgagauguacugggucagcaacgccacggggaacaucguguccagcgugaacaugaucucccggaugcucaucaaccgcuucaccaugaagcacaagaaggccaccuacgagcccgacgucgaccugggcagcgggacccgcaacaucggcaucgaguccgagauccccaaccuggacaucaucggcaagcggaucgagaagaucaagcaggagcacgagacgagcuggcacuacgaccaggaccacccguacaagaccugggcguaccacggguccuacgagaccaagcagaccggcagcgccuccagcauggugaacggggugguccgccuccugacgaagcccugggacguggugcccauggucacccagauggccaugaccgacaccacgcccuucggccagcagcggguguucaaggagaagguggacacccgcacccaggagccgaaggagggcaccaagaagcugaugaagaucacggccgaguggcucuggaaggagcuggggaagaagaagacgccccggaugugcacccgcgaggaguucacccggaagguccgcuccaacgccgcgcugggcgccaucuucacggacgagaacaaguggaaguccgcccgggaggccguggaggacucccgcuucugggagcucguggacaaggagcggaaccugcaccuggaggggaagugcgagaccugcgucuacaacaugaugggcaagcgcgagaagaagcucggggaguucggcaaggcgaagggcagccgggccaucugguacauguggcugggggcccgcuuccuggaguucgaggcccucggcuuccugaacgaggaccacugguucucccgggagaacagccugagcgggguggagggcgaggggcuccacaagcugggcuacauccugcgcgacgucuccaagaaggagggcggggccauguacgcggacgacaccgccggcugggacacccggaucacgcucgaggaccugaagaacgaggagauggugaccaaccacauggagggggagcacaagaagcuggccgaggccaucuucaagcucaccuaccagaacaaggugguccgcgugcagcggcccacgccccggggcacggugauggacaucaucagccggcgcgaccagcgcggguccggccaggucggcaccuacgggcugaacaccuucaccaacauggaggcccagcugauccggcagauggagggcgaggggguguucaagagcauccagcgccucacggugaccgaggagaucgcgguccagaacuggcuggcccgggugggccgcgagcggcugucccgcauggccaucagcggcgacgacugcguggucaagccgcucgacgaccgguucgccuccgcccugaccgcgcugaacgacauggggaaggugcgcaaggacauccagcagugggagcccagccggggcuggaacgacuggacccaggugcccuucugcucccaccacuuccacgagcucaucaugaaggacgggcgcguccugguggugcccugccggaaccaggacgagcugaucggccgcgcccggaucagccagggggccggcuggucccucaaggagacggccugccugggcaagagcuacgcccagauguggucccugauguacuuccaccgccgggaccuccgccuggcggccaacgccaucugcagcgccgucccgucccacugggugcccaccagccggaccaccugguccauccacgcgaagcacgaguggaugaccacggaggacaugcugaccguguggaaccgcgucuggauccaggagaaccccuggauggaggacaagacccccguggagagcugggaggaggugccguaccucgggaagcgggaggaccaguggugcggcagccugaucgggcugaccucccgcgccacgugggccaagaacauccagaccgccaucaaccagguccgcagccucaucggcaacgaggaguacaccgacuacaugcccuccaugaagcgguuccgccgggaggaggaggaggccggggugcugugguga

SEQ ID NO: 9650 - RNA, 9876 nt, Artificial Sequence
  derived and/or modified CDS sequence (opt1) from DENV-2__FM210232__SS-prME
accgccggcgugaucaucaugcugauccccaccgccauggcguuccaccucaccacccgcaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacccuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgacaucaaggggaucaugcaggccggcaagcggucccugcgcccccagcccaccgagcugaaguacagcuggaagaccuggggcaaggccaagaugcucuccaccgagagccacaaccagacguuccugaucgacgggccggagaccgccgagugccccaacaccaaccgggccuggaacucccuggagguggaggacuacggcuucgggguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggucaagagcugccacuggcccaagucccacacccuguggagcaacggcgugcuggaguccgagaugaucauccccaagagcuucgccgggccggugucccagcacaacuaccgccccggcuacuacacccagaccgccgggcccuggcaccucggcaagcuggagauggacuucgacuucugcgaggggacgaccguggucgugaccgaggccugcggcaaccggggccccagccugcgcaccacgaccgcgagcgggaagcucaucaccgaguggugcugccgguccugcacccugccgccccugcgcuaccggggcgaggacgggugcugguacggcauggagauccgcccccucaaggagaaggaggagaaccuggugaacagccuggucacggccgggcacggccagaucgacaacuucucccucggcgugcuggggauggcccuguuccucgaggagaugcugcggacccgcgugggcaccaagcacgccauccugcucgucaccgugagcuucgugacgcugaucaccgggaacauguccuuccgggaccugggccgcgucauggugauggugggggccgcgaugaccgacgacaucggcaugggcgucaccuaccucgcccugcuggccgccuucaaggugcgccccacguucgccgcggggcuccugcugcggaagcucaccagcaaggagcugaugauggccaccaucggcaucgcccugcucucccagagcaccaucccggagacgauccuggagcugaccgacgcccucgcccuggggaugauggugcugaagaucguccgcaacauggagaaguaccagcucgcggugaccaucauggccaucuccugcgugcccaacgccgucauccugcagaacgccuggaaggugagcugcaccauccuggcggccguguccgucagcccccuccugcugacguccagccagcagaaggccgacuggaucccccucgcccugaccaucaagggccugaacccgaccgccaucuuccucaccacgcugucccggaccagcaagaagcgcuccuggccccugaacgaggcgaucauggccgugggcauggucagcauccucgccuccagccugcugaagaacgacauccccaugaccgggccccucguggccggcgggcugcugaccgugugcuacguccucacgggccggagcgccgaccuggagcuggagcgcgcgaccgacgugaagugggaggaccaggccgagaucuccgggagcuccccgauccucagcaucaccaucgccgaggacggcuccaugagcaucaagaacgaggaggaggagcagacccugacgauccugauccggaccggccuccuggugaucuccgggcuguuccccgucagcauccccaucaccgccgccgcgugguaccucugggaggugaagaagcagcgcgccggcgugcugugggacguccccuccccgccgcccguggggaaggccgagcuggaggacggcgccuaccggaucaagcagaaggggauccucggcuacagccagaucggcgccgggguguacaaggagggcaccuuccacaccauguggcacgucacgcgcggggcggugcugaugcaccggggcaagcgcaucgagccguccugggccgacgugaagaaggaccugaucagcuacgggggcggcuggaagcucgagggggaguggaaggagggcgaggagguccaggugcuggcccuggagcccgggaagaacccccgggccgugcagaccaagcccggccucuucaagaccaacaccgggacgaucggcgcggucucccuggacuucagcccgggcaccuccgggagccccaucguggaccgcaagggcaagguggucgggcuguacggcaacggcguggugacccgguccggggccuacgucagcgccaucgcccagaccgagaaguccaucgaggacaaccccgagaucgaggacgacaucuuccgcaagaagcggcucacgaucauggaccugcaccccggcgccgggaagaccaagcgcuaccugccggcgaucgugcgggaggccaucaagcgcggccugcggacccucauccuggcccccacccgcguggucgccgccgagauggaggaggcgcugcgcgggcuccccauccgguaccagacgcccgccauccgcgccgagcacaccggccgggagaucguggaccugaugugccacgccaccuucaccaugcgccugcucagcccggugcggguccccaacuacaaccugaucaucauggacgaggcccacuucacggaccccgcgagcaucgccgcccgcggcuacaucuccacccggguggagaugggggaggccgcgggcaucuucaugaccgccacgccgcccgggagccgcgaccccuucccccaguccaacgcccccaucauggacgaggagcgggagauccccgagcgcagcuggaacuccggccacgagugggugacggacuucaaggggaagaccgucugguucgugcccagcaucaaggccggcaacgacaucgccgcgugccugcggaagaacggcaagaaggugauccagcucucccgcaagaccuucgacagcgaguacgucaagacccggacgaacgacugggacuucguggugaccaccgacaucuccgagaugggggccaacuucaaggccgagcgcgucaucgacccccggcgcugcaugaagcccgugauccugaccgacggcgaggagcgggugauccuggccgggccgaugcccgucacgcacagcuccgccgcgcagcgccggggccgcaucgggcgcaaccccaagaacgagaacgaccaguacaucuacaugggcgagccccucgagaacgacgaggacugcgcccacuggaaggaggccaagaugcugcuggacaacaucaacaccccggagggcaucauccccagcauguucgagcccgagcgggagaagguggacgccaucgacggggaguaccgccuccggggcgaggcccgcaagaccuucguggaccugaugcggcgcggggaccugccggucuggcucgcguaccggguggccgccgagggcaucaacuacgccgaccgccgguggugcuucgacggggugaagaacaaccagauccuggaggagaacgucgagguggagaucuggaccaaggagggcgagcgcaagaagcugaagccccgguggcucgacgcgcgcaucuacuccgacccccuggcccugaaggaguucaaggaguucgccgccggccgcaagagccucacgcugaaccugaucaccgagauggggcgccuccccaccuucaugacccagaaggcccgggacgcgcuggacaaccuggccgugcuccacacggccgaggccggcgggcgcgccuacaaccacgcgcuguccgagcugccggagacccucgagacccugcugcuccugacccugcucgccacggucaccggcggcaucuuccuguuccugaugagcgggaagggcguggggaagaugacccucggcaugugcugcaucaucaccgccuccauccugcugugguacgcccagauccagccccacuggaucgccgcgagcaucauccucgaguucuuccugaucguccugcucauccccgagcccgagaagcagcggaccccgcaggacaaccagcugacguacguggugaucgccauccugaccgucguggccgccaccauggccaacgagaugggguuccucgagaagaccaagaaggaccugggccugggcuccaucgcgacgcaggagcccgagagcaacauccucgacaucgaccugcgccccgccagcgccuggacccuguacgccguggcgaccaccuucgucacgcccaugcuccggcacuccaucgagaacagcuccgugaacgugagccugaccgccaucgccaaccaggccaccguccugauggggcucggcaagggguggccgcuguccaagauggacaucggcgugccccugcucgccaucgggugcuacagccaggugaaccccaucacccugacggcggcccugcuccugcuggucgcccacuacgccaucaucggccccggccuccaggccaaggcgacccgcgaggcccagaagcgggccgccgccgggaucaugaagaacccgaccguggacggcgugaccgucaucgaccuggaccccauccccuacgaccccaaguucgagaagcagcugggccaggugaugcuccugauccugugcgugacgcagguccucaugaugcgcaccaccugggcgcugugcgaggcccugacccucgccacgggcccgaucuccacccugugggaggggaaccccggccgcuucuggaacaccaccaucgccgugagcauggcgaacaucuuccggggcuccuaccuggccggggccggccuccuguucagcaucaugaagaacacgaccaacacccgccgggggaccggcaacaucggcgagacgcugggggagaaguggaagucccgccucaacgcccugggcaagagcgaguuccagaucuacaagaaguccgggauccaggagguggaccggacccuggccaaggagggcaucaagcgcggggagaccgaccaccacgcggucagccggggcuccgccaagcuccgcugguucguggagcggaacauggugacccccgagggcaaggucguggaccuggggugcggccgcgggggcuggagcuacuacugcgggggccugaaggacgugcgggaggucaagggccucacgaagggcgggcccgggcacgaggagccgauccccauguccaccuacggcuggaaccuggugcgccugcagagcgggguggacgucuucuucacgccgcccgagaagugcgacacccuccugugcgacaucggcgaguccagcccgaaccccacgaucgaggccggccggacccugcgcgugcucagccugguggagaacuggcugaacaacgacacccaguucugcaucaagguccucaaccccuacaugccguccgugaucgagaagauggagacccugcagcggaaguacgggggcgcccuggugcgcaacccccugagccggaacuccacccacgagauguacugggucagcaacgccacggggaacaucguguccagcgugaacaugaucucccgcaugcucaucaaccgguucaccaugaagcacaagaaggcgaccuacgagcccgacgucgaccugggcagcgggacccgcaacaucggcaucgaguccgagauccccaaccuggacaucaucggcaagcgcaucgagaagaucaagcaggagcacgagacgagcuggcacuacgaccaggaccacccguacaagaccugggccuaccacggguccuacgagaccaagcagaccggcagcgccuccagcauggugaacggggugguccggcuccugacgaagcccugggacguggugcccauggucacccagauggccaugaccgacaccacgcccuucggccagcagcgcguguucaaggagaagguggacacccggacccaggagccgaaggagggcaccaagaagcugaugaagaucacggccgaguggcucuggaaggagcuggggaagaagaagacgccccggaugugcacccgggaggaguucacccgcaagguccgguccaacgcggcccugggcgccaucuucacggacgagaacaaguggaaguccgcccgcgaggcgguggaggacucccgguucugggagcucguggacaaggagcgcaaccugcaccuggaggggaagugcgagaccugcgucuacaacaugaugggcaagcgggagaagaagcucggggaguucggcaaggccaagggcagccgcgccaucugguacauguggcugggggcccgguuccuggaguucgaggcccucggcuuccugaacgaggaccacugguucucccgcgagaacagccugagcgggguggagggcgaggggcuccacaagcugggcuacauccugcgggacgucuccaagaaggagggcggggcgauguacgccgacgacaccgccggcugggacacccgcaucacgcucgaggaccugaagaacgaggagauggugaccaaccacauggagggggagcacaagaagcuggccgaggccaucuucaagcucaccuaccagaacaaggugguccgggugcagcgccccacgccccggggcacggugauggacaucaucagccgccgggaccagcgcggguccggccaggucggcaccuacgggcugaacaccuucaccaacauggaggcgcagcugauccgccagauggagggcgaggggguguucaagagcauccagcaccucacggugaccgaggagaucgccguccagaacuggcuggcccgggugggccgcgagcggcugucccgcauggccaucagcggcgacgacugcguggucaagccgcucgacgaccgguucgccuccgcgcugaccgcccugaacgacauggggaaggugcgcaaggacauccagcagugggagcccagccggggcuggaacgacuggacccaggugcccuucugcucccaccacuuccacgagcucaucaugaaggacgggcgcguccugguggugcccugccggaaccaggacgagcugaucggccgcgcccggaucagccagggggccggcuggucccucaaggagacggccugccugggcaagagcuacgcgcagauguggucccugauguacuuccaccgccgggaccuccgccuggccgccaacgccaucugcagcgcggucccgucccacugggugcccaccagccggaccaccugguccauccacgccaagcacgaguggaugaccacggaggacaugcugaccguguggaaccgcgucuggauccaggagaaccccuggauggaggacaagacccccguggagagcugggaggaggugccguaccucgggaagcgggaggaccaguggugcggcagccugaucgggcugaccucccgcgccacgugggccaagaacauccagaccgccaucaaccagguccggagccucaucggcaacgaggaguacaccgacuacaugcccuccaugaagcgcuuccgccgggaggaggaggaggcgggggugcugugguga

SEQ ID NO: 9651 - RNA, 9876 nt, Artificial Sequence
  derived and/or modified CDS sequence (opt1) from DENV-2__FM210233__SS-prME
agcgcggggaugaucaucaugcugauccccaccgugauggccuuccaccucaccacccgcaacggggagccccacaugaucgucgggauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacauccgcggcaucaugcaggccgggaagcggagccugcgcccgcagcccacggagcugaaguacuccuggaagaccuggggcaaggccaagaugcucagcaccgaguccuacaaccagaccuuccugaucgacggccccgagacggcggagugcccgaacaccaaccgggccuggaacagccuggagguggaggacuacggguucggcgucuucaccaccaacaucuggcucaagcugaaggagaagcaggacgccuucugcgacuccaagcugaugagcgccgccaucaaggacaaccgcgcggugcacgccgacaugggguacuggauggaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccggccgggguaccacacccagaucgcgggccccuggcaccuggggaagcuggagauggacuucgacuucugcgacggcaccaccgugaucgucacggaggacugcgggaaccgcggccccucccuccggaccaccaccgccagcggcaagcugaucacggaguggugcugccgcagcugcacccugcccccgcuccgguaccgcggggaggacggcugcugguacgggauggagauccggccccugaaggagaaggaggagaaccuggugaacucccucgugaccgccggccacgggcaggucgacaacuucagccugggcgugcugggcauggcccucuuccuggaggagaugcugcgcacccggguggggacgaagcacgcgauccuccuggucgccguguccuucgugacccugaucaccggcaacaugagcuucaaggaccucgggcgcgucguggugauggucggcgccaccauggccgacgacaucgggaugggcgugacguaccuggcccugcucgcggccuucaaggugcggcccaccuucgccgccggccugcugcuccgcaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccggacgaacaagaagcgcagcuggccgcugaacgaggccaucauggcggucggcaugguguccauccuggccagcucccuccugaagaacgacauccccaugaccggcccccugguggccgggggccuccugaccgucugcuacgugcugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgucaucuccggccuguucccgaucagcauccccaucaccgccgccgccugguaccugugggaggugaagaagcagcgcgccggggugcucugggacguccccagcccgccgcccaugggcaaggcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccgggucguggccgccgagauggaggaggcccugcgcggccugcccauccgguaccagacccccgccauccgcgcggagcacacggggcgcgagaucguggaccucaugugccacgccaccuucaccaugcggcugcugagccccguccgcgugccgaacuacaaccucaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagacggugugguucgugccgagcaucaaggcggggaacgacaucgccgccugccugcgcaagaacggcaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccucaccgacggggaggagcgcgucauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaagguggacgccaucgacggcgaguaccgccugcgcggggaggcccggaagaccuucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccguccugcacacggccgaggccggcgggcgcgccuacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucacguacgucgugaucgccauccugaccguggucgccgcgaccauggccaacgagaugggcuuccuggagaagaccaagcgggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccgccggggcaccgggaacaucggcgagacgcugggcgagaaguggaagucccgccugaacgcccucggcaagagcgaguuccagaucuacaagaaguccggcauccaggaggucgaccggacccuggcgaaggaggggaucaagcgcggcgagaccgaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugacgaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgaccguggaggccggccggacgcugcgcguccugaaccucguggagaacuggcugaacaacaacacccaguucugcaucaaggugcugaaccccuacaugcccuccgucaucgagaagauggaggcgcugcagcggaaguacggcggggcccucgugcgcaacccgcugagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggucaacggcguggugcgccugcucaccaagccgugggacguccugcccaccgugacccagauggccaugacggacaccacccccuucgggcagcagcggguguucaaggagaaggucgacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggcgaucuucaccgacgagaacaaguggaaguccgcccgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcgucgagggggagggccuccacaagcugggguacauccugcgcgacgugagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggucgugcgcgugcagcggcccacgccccgcgggaccgucauggacaucaucagccggcgcgaccagcggggcuccggccaggugggcaccuacggccugaacacguucaccaacauggaggcccagcugauccgccagauggagggggagggcguguucaagaacauccagcaccucaccgucaccgaggagguggccgugcacaacuggcuggcgcgcgucgggcgggagcgccugagccggauggccaucuccggcgacgacugcguggugaagccccucgacgaccgcuucgccaacgcccugacggcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccgugcccucccacugggugccgaccagccgcacgaccugguccauccacgccaagcacgaguggaugaccaccgaggacaugcugaccgucuggaaccggguguggauccgcgagaaccccuggauggaggacaagacgcccguggagagcugggaggagauccccuaccucggcaagcgggaggaccaguggugcgggucccugaucggccugaccagccgcgccaccugggcgaagaacauccaggccgccaucaaccagguccggucccucaucgggaacgaggaguacaccgacuacaugccgagcaugaagcgcuuccgccgggaggaggaggaggccggcgugcugugguga

SEQ ID NO: 9652 - RNA, 9876 nt, Artificial Sequence
  derived and/or modified CDS sequence (opt1) from DENV-2__FM210241__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugacguacgggaccugcaccaccacgggcgagcaccggcgcgagaagcgguccgucgcccuggugccccacguggggaugggccucgagacccgcaccgagaccuggaugagcagcgagggggccuggaagcacgcccagcggaucgagacguggauccugcgccaccccggcuucaccaucauggcggccauccuggccuacaccaucgggaccacgcacuuccagcgggcccucaucuucauccugcugaccgcggucgcccccagcaugaccaugcgcugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccgcaaguacugcaucgaggcgaagcugacgaacaccaccaccgagucccggugcccgacgcagggcgagcccagccugaacgaggagcaggacaagcgcuucgucugcaagcacuccaugguggaccggggcugggggaacggcugcgggcuguucggcaagggcgggaucgugaccugcgccauguucacgugcaagaagaacauggagggcaagaucguccagcccgagaaccuggaguacaccaucgugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccgcaccggccucgacuucaacgagauggugcugcugcagauggaggacaaggccuggcucgugcaccggcagugguuccuggaccugccccuccccuggcugccgggggcggacacccagggcagcaacuggauccagaaggagacgcuggucaccuucaagaacccccacgccaagaagcaggacguggugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgcggagacccagcacgggacgaucgucauccgcgugcaguacgagggcgacggcucccccugcaagauccccuucgagaucauggaccuggagaagcggcacgugcucgggcgccugaucaccgucaacccgaucgugaccgagaaggacagccccgugaacaucgaggccgagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucgggggcguguucaccuccaucgggaaggcgcuccaccagguguucggcgccaucuacggcgccgccuucagcggggucuccuggaccaugaagauccugaucggcgcgaucaucacguggaucgggaugaacagccgcuccaccagccuguccgugagccuggugcucgucggcgugaucacccuguaccugggggccauggugcaggccgacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcgcacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggccaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgagaagcaggacguguucugcgacuccaagcugaugagcgcggccaucaaggacaaccgggccgugcacgccgacaugggcuacuggaucgaguccgcccucaacgacaccuggaagauggagaaggcgagcuucaucgaggucaaguccugccacuggcccaagagccacacccugugguccaacggcgugcuggagagcgagaugaucauccccaaguccuucgccgggcccgugagccagcacaacuaccgcccgggcuacuacacccagacggccgggcccuggcaccucggcaagcuggagauggacuucgacuucugcgaggggaccaccgucguggugaccgaggacugcggcaaccggggccccagccugcgcacgaccaccgccuccgggaagcucaucaccgaguggugcugccggagcugcacgcugcccccgcugcgcuaccggggcgaggacgggugcugguacggcauggagauccgcccccucaaggagaaggaggagaaccuggucaacucccuggugaccgcggggcacggccagaucgacaacuucagccucggcgugcuggggauggcccuguuccucgaggagaugcugcggacccgcgucggcaccaagcacgccauccugcucguggccguguccuucgucacgcugaucaccgggaacaugagcuuccgggaccugggccgcgugauggugauggucggggccaccaugaccgacgacaucggcaugggcgugacguaccucgcgcugcuggccgccuucaaggugcgccccaccuucgccgccgggcuccugcugcggaagcucaccuccaaggagcugaugauggcgaccaucggcaucgcccugcucagccaguccacgauccccgagaccauccuggagcugaccgacgcccucgcccuggggaugaugguccugaagaucgugcgcaacauggagaaguaccagcucgccgugaccaucauggcgaucagcugcgucccgaacgccgugauccugcagaacgccuggaagguguccugcacgauccuggccgcggucagcgugagcccccugcugcugaccagcucccagcagaaggccgacuggaucccccucgcccugaccaucaagggccugaaccccaccgccaucuuccucacgacccugagccggaccuccaagaagcgcagcuggccgcugaacgaggccaucauggcggugggcauggucuccauccucgccagcagccugcugaagaacgacauccccaugaccgggccccucguggccggcgggcugcugacggucugcuacgugcucaccggccgguccgccgaccuggagcuggagcgcgccaccgacgugaagugggaggaccaggcggagaucagcggguccagccccauccucuccaucaccaucagcgaggacggcuccaugagcaucaagaacgaggaggaggagcagacgcugaccauccugauccggaccggccuccuggucaucuccgggcuguucccggugagcauccccaucaccgccgccgccugguaccucugggaggugaagaagcagcgcgccggcguccugugggacgugcccagcccgccgcccguggggaaggcggagcuggaggacggcgccuaccggaucaagcagaaggggauccucggcuacagccagaucggcgccggggucuacaaggagggcaccuuccacacgauguggcacgugacccgcggggccgugcugaugcaccggggcaagcgcaucgagcccuccugggccgacgucaagaaggaccugaucagcuacgggggcggcuggaagcucgagggggaguggaaggagggcgaggagguccaggugcuggcgcuggagcccgggaagaacccccgggccguccagaccaagcccggccucuucaagaccaacacggggaccaucggcgccgugucccuggacuucagccccggcaccuccgggagccccaucguggaccgcaagggcaaggucguggggcuguacggcaacggcguggucacccgguccggggccuacgugagcgcgaucgcccagacggagaaguccaucgaggacaaccccgagaucgaggacgacaucuuccgcaagaagcggcucaccaucauggaccugcaccccggcgccgggaagaccaagcgcuaccugcccgccaucgugcgggaggccaucaagcgcggccugcggacccucauccuggcgccgacgcgcgucguggccgccgagauggaggaggcccugcgcgggcuccccauccgguaccagacccccgccauccgcgcggagcacaccggccgggagaucguggaccugaugugccacgccaccuucacgaugcgccugcucucccccguccgggugccgaacuacaaccugaucaucauggacgaggcccacuucaccgaccccgccagcaucgccgcgcgcggcuacaucuccacccggguggagaugggggaggccgccggcaucuucaugaccgccacgccgcccgggagccgcgacccguucccccaguccaacgcgcccaucaucgacgaggagcgggagauccccgagcgcagcuggaacuccggccacgagugggucaccgacuucaaggggaagaccgugugguucgugccgagcaucaaggccggcaacgacaucgccgccugccugcggaagaacggcaagaaggucauccagcucucccgcaagaccuucgacagcgaguacgugaagacgcggaccaacgacugggacuucguggucaccaccgacaucuccgagaugggggccaacuucaaggcggagcgcgugaucgacccccggcgcugcaugaagcccgugauccugacggacggcgaggagcgggucauccuggccgggcccaugccggugacccacagcuccgccgcccagcgccggggccgcaucgggcgcaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgggagaagguggacgccaucgacggggaguaccgccuccggggcgaggcccgcaagaccuucgucgaccugaugcggcgcggggaccugcccguguggcucgccuaccggguggccgcggagggcaucaacuacgccgaccgccgguggugcuucgacggggucaagaacaaccagauccuggaggagaacguggagguggagaucuggacgaaggagggcgagcgcaagaagcugaagccgcgguggcucgacgcccgcaucuacuccgacccccuggcccugaaggaguucaaggaguucgcggccggccggaagucccucacccugaaccugaucaccgagauggggcgccuccccaccuucaugacgcagaaggcccgggacgcccuggacaaccuggccguccuccacaccgcggaggccggcgggcgcgccuacaaccacgcccuguccgagcugcccgagacccucgagacccugcugcuccugacgcugcucgccaccgugaccggcggcaucuuccuguuccugaugagcgggaagggcguggggaagaugacccucggcaugugcugcaucaucaccgcguccauccugcugugguacgcccagauccagccgcacuggaucgccgccagcaucauccucgaguucuuccugaucguccugcucauccccgagcccgagaagcagcggacgccccaggacaaccagcugaccuacguggucaucgccauccugaccgugguggcggccaccauggccaacgagaugggguuccucgagaagacgaagaaggaccugggccugggcagcaucgccacccaggagccggaguccaacauccucgacaucgaccugcgccccgccagcgcguggacccuguacgccgucgccaccacguucgugacccccaugcuccggcacuccaucgagaacagcuccgugaacgucagccugaccgccaucgcgaaccaggccaccgugcugauggggcucggcaagggguggccccuguccaagauggacaucggcgugccgcugcucgccaucgggugcuacagccaggucaaccccaucacgcugaccgccgcccugcucucccugaucgcgcacuacgccaucaucggccccggccugcaggccaaggccacccgcgaggcccagaagcgggcggccgccgggaucaugaagaaccccaccguggacggcaucacggugaucgaccucgacccgauccccuacgaccccaaguucgagaagcagcuggggcaggucaugcugcucauccugugcgugacccaggugcugaugaugcgcaccaccugggcccucugcgaggcccugacgcuggcgaccggccccaucagcacccucugggaggggaacccgggccgcuucuggaacaccacgaucgccgucuccauggccaacaucuuccggggcagcuaccuggccggggcgggccuccucuucuccaucaugaagaacaccaccaacacccgccgggggacgggcaacaucggcgagacccugggggagaaguggaagucccgccugaacgcccucggcaaguccgaguuccagaucuacaagaaguccgggauccaggagguggaccggacccuggccaaggagggcaucaagcgcggggagaccgaccaccacgccgugucccggggcagcgccaagcugcgcugguucgucgagcggaacauggugacgcccgagggcaagguggucgaccucgggugcggccgcgggggcugguccuacuacugcgggggccugaagaacgugcgggaggugaagggccugaccaagggcggccccgggcacgaggagcccaucccgaugagcaccuacggcuggaaccucguccgccugcagagcgggguggacguguucuucacgccgcccgagaagugcgacacgcugcucugcgacaucggcgaguccagccccaacccgaccaucgaggcgggccggacccugcgcguccugucccucguggagaacuggcugaacaacgacacccaguucugcaucaaggugcugaaccccuacaugcccagcgucaucgagaagauggagacccuccagcggaaguacgggggcgcccuggugcgcaacccgcugucccggaacagcacgcacgagauguacuggguguccaacgccaccgggaacaucgucagcuccgugaacaugaucagccgcaugcugaucaaccgguucaccaugaagcacaagaaggccaccuacgagcccgacguggaccucggcuccgggacgcgcaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagaccaagcagacgggcuccgcgagcuccauggucaacgggguggugcggcugcucaccaagccgugggacgucgugcccauggugacccagauggccaugaccgacacgacccccuucggccagcagcgcgucuucaaggagaagguggacacccggacccaggagcccaaggagggcacgaagaagcugaugaagaucaccgccgaguggcuguggaaggagcucgggaagaagaagaccccgcgcaugugcacccgggaggaguucacgcgcaaggugcggagcaacgccgcccugggcgcgaucuucaccgacgagaacaaguggaaguccgcccgcgaggccgucgaggacagccgguucugggagcugguggacaaggagcgcaaccuccaccuggaggggaagugcgagaccugcguguacaacaugaugggcaagcgggagaagaagcugggggaguucggcaaggccaagggcagccgcgcgaucugguacauguggcucggggcccgguuccuggaguucgaggcccugggcuuccucaacgaggaccacugguucucccgcgagaacagccuguccggggucgagggcgaggggcugcacaagcucggcuacauccugcgggacgugagcaagaaggagggcggggccauguacgccgacgacaccgcgggcugggacacgcgcaucacccuggaggaccucaagaacgaggagauggugaccaaccacauggagggggagcacaagcggcuggccgaggccaucuucaagcugaccuaccagaacaaggucgugcgcguccagcggcccacgccccgcggcaccgugauggacaucaucucccggcgcgaccagcgcgggagcggccaggugggcaccuacgggcucaacaccuucacgaacauggaggcccaguucauccggcagauggagggcgaggggaucuucaaguccauccagcaccugaccgucaccgaggagaucgccgugcagaacuggcuggcgcgcgugggccgggagcgccucagccggauggccaucuccggcgacgacugcgucgugaagccccuggacgaccgcuucgccagcgcccugaccgcccucaacgacauggggaaggugcggaaggacauccagcagugggagccguccaagggcuggaacgacuggacgcagguccccuucugcagccaccacuuccacgagcugaucaugaaggacgggcgcgugcuggugguccccugccggaaccaggacgagcucaucggccgcgcgcggaucucccagggggccggcuggagccugaaggagaccgccugccugggcaaguccuacgcccagauguggagccucauguacuuccaccgccgggaccugcgccuggccgcgaacgccaucugcuccgccgugcccagccacugggugccgaccagccggaccaccugguccauccacgccaagcacgaguggaugacgaccgaggacaugcucaccgucuggaaccgcguguggauccaggagaaccccuggauggaggacaagacccccguggagagcugggaggagguccccuaccuggggaagcgggaggaccaguggugcggcucccugaucgggcucacgagccgcgcgaccugggccaagaacauccagaccgccaucaaccaggugcggucccugaucggcaacgaggaguacaccgacuacaugccgagcaugaagcgcuuccgccgggaggaggaggaggccggggugcugugguga

SEQ ID NO: 9653 - RNA, 9876 nt, Artificial Sequence
  derived and/or modified CDS sequence (opt1) from DENV-2__FM210242__SS-prME
agcgcggggaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccggcgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccguggugcuccagaacgccuggaaggucagcugcaccauccuggcggugguguccgucagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggugggcaugguguccauccuggccagcucccuccugaagaacgacauccccaugaccggcccccuggucgccgggggccuccugaccgugugcuacgugcugaccgggcgcagcgccgaccucgagcuggagcgggccacggacgucaagugggaggaccaggcggagaucuccggcagcagccccauccuguccaucaccaucagcgaggacggguccaugagcaucaagaacgaggaggaggagcagacccucaccauccugauccgcacgggccugcucgugaucuccggccuguucccgaucagcauccccaucaccgccgccgccugguaccugugggaggugaagaagcagcgggccgggguccucugggacgugcccagcccgccgcccaugggcaaggcggagcuggaggacggggccuaccgcaucaagcagaagggcauccugggguacagccagaucggcgccggcguguacaaggaggggaccuuccacaccauguggcacgucacccggggcgccgugcucaugcacaaggggaagcgcaucgagcccuccugggccgacgugaagaaggaccugaucagcuacggcgggggcuggaagcuggagggcgaguggaaggagggggaggagguccaggugcucgcgcuggagcccggcaagaacccccgggccgugcagacgaagcccgggcuguucaagaccaacaccggcaccaucggggccgucucccucgacuucagccccggcacguccggcagccccaucaucgacaagaaggggaagguggugggccuguacgggaacggcgucgugacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucguccgggaggccaucaagcgcgggcugcggacccugauccucgcgccgacccgcgugguggccgccgagauggaggaggcccugcggggccugcccauccgcuaccagacccccgccaucaaggcggagcacacggggcgggagaucgucgaccucaugugccacgccaccuucaccaugcgccugcugagccccgugcgcgugccgaacuacaaccucaucaucauggacgaggcccacuucaccgaccccgccuccaucgccgcgcggggcuacaucagcacgcgcgucgagaugggcgaggccgccgggaucuucaugaccgccacgccgcccggcagccgggacccguucccccaguccaacgcccccaucaucgacgaggagcgcgagauccccgagcggagcuggaacuccgggcacgagugggugaccgacuucaagggcaagacggugugguucgucccgagcaucaaggcggggaacgacaucgccgccugccugcgcaagaacggcaagaaggugauccagcugucccggaagaccuucgacagcgaguacgugaagacccgcaccaacgacugggacuucgucgugacgaccgacaucuccgagaugggcgccaacuucaaggcggagcgggugaucgacccccgccggugcaugaagcccgucauccucaccgacggggaggagcgcgugauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaaggucgacgccaucgacggcgaguaccgccugcgcggggaggcccgcaagaccuucguggaccucaugcgccggggcgaccugcccguguggcuggccuacaaggucgccgcggaggggaucaacuacgccgaccgccgguggugcuucgacggcaucaagaacaaccagauccucgaggagaacguggaggucgagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccgugcugcacacggccgaggccggcgggcgcgccuacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgccuccauccuccugugguacgcgcagauccagccgcacuggaucgccgccagcaucauccuggaguucuuccucaucguccugcugauccccgagcccgagaagcagcgcacgccccaggacaaccagcucacguacguggugaucgccauccugaccgucguggccgcgaccauggccaacgagaugggcuuccuggagaagaccaagaaggaccucgggcugggcuccaucgccacgcagcagccggagagcaacauccuggacaucgaccuccggcccgccuccgccuggacccuguacgcgguggccaccaccuucgucacgcccaugcugcgccacagcaucgagaacagcuccgugaacgugagccucaccgccaucgccaaccaggccaccguccugaugggccuggggaagggcuggccccucuccaagauggacaucggggugccgcugcuggcgaucggcugcuacagccaggugaaccccaucacccucacggccgcccugcugcuccuggucgcccacuacgcgaucaucgggcccggccugcaggccaaggccacccgggaggcccagaagcgcgccgcggccggcaucaugaagaaccccaccguggacgggaucaccgugaucgaccucgacccgauccccuacgaccccaaguucgagaagcagcugggccaggucaugcugcucauccugugcgugacccaggugcugaugaugcggaccaccugggcccucugcgaggcccugacccuggccacggggcccaucuccacccucugggagggcaacccggggcgcuucuggaacaccaccaucgcggucagcauggccaacaucuuccggggcuccuaccuggccggcgccgggcuccucuucagcaucaugaagaacacgaccaacacccgccggggcaccgggaacaucggcgagacgcugggcgagaaguggaagucccgccugaacgcccucggcaagagcgaguuccagaucuacaagaaguccggcauccaggagguggaccgcacccuggcgaaggaggggaucaagcggggcgagaccgaccaccacgccgugagccgcggguccgccaagcugcggugguucgucgagcgcaacauggugacccccgagggcaagguggucgaccucggcugcgggcggggcggguggagcuacuacugcggcgggcugaaguccgugcgcgaggugaagggccugacgaagggcgggcccggccacgaggagcccaucccgaugagcaccuacggguggaaccucguccggcugcaguccggcguggacguguucuucaucccgcccgagaagugcgacacccugcucugcgacaucggggagagcucccccaacccgaccgucgaggccggccgcacgcugcgggugcugaaccucguggagaacuggcugaacaacaacacccaguucugcaucaagguccugaaccccuacaugcccagcgugaucgagaagauggaggcgcugcagcgcaaguacggcggggcccucgugcggaacccgcugagccgcaacuccacccacgagauguacugggucagcaacgccuccggcaacaucgugagcuccgugaacaugaucagccggaugcugaucaaccgcuucaccaugcggcacaagaaggccaccuacgagcccgacgucgaccucggguccggcacgcgcaacaucgggaucgagagcgagauccccaaccuggacaucaucggcaagcggaucgagaagaucaagcaggagcacgagaccuccuggcacuacgaccaggaccaccccuacaagaccugggccuaccacggcagcuacgagaccaagcagacgggguccgcgagcuccauggugaacggcgugguccgccugcucaccaagccgugggacgugcugcccaccgugacccagauggccaugacggacaccacccccuucgggcagcagcgggucuucaaggagaagguggacacccgcacgcaggagcccaaggagggcaccaagaagcugaugaagaucaccgccgaguggcucuggaaggagcugggcaagaagaagaccccgcgcaugugcacgcgggaggaguucacccgcaaggugcggagcaacgccgcccugggggcgaucuucaccgacgagaacaaguggaaguccgcccgcgaggccgucgaggacagccgguucugggagcucguggacaaggagcgcaaccugcaccuggagggcaagugcgagaccugcgucuacaacaugauggggaagcgggagaagaagcucggcgaguucgggaaggccaagggcucccgcgccaucugguacauguggcugggcgcgcgguuccuggaguucgaggcccucggguuccugaacgaggaccacugguucagccgcgagaacucccugagcggcguggagggggagggccuccacaagcugggguacauccugcgggacgugagcaagaaggagggcggcgccauguacgccgacgacacggcggggugggacacccgcaucacccucgaggaccugaagaacgaggagauggucaccaaccacauggagggcgagcacaagaagcuggccgaggccaucuucaagcucacguaccagaacaagguggugcggguccagcgccccacgccccgggggaccgugauggacaucaucucccgccgggaccagcgcggcagcggccagguggggaccuacggccugaacacguucaccaacauggaggcccagcugauccggcagauggagggggagggcgucuucaagaacauccagcaccucaccgugaccgaggagguggccguccagaacuggcuggcgcgcguggggcgggagcgccugucccgcauggccaucagcggcgacgacugcguggucaagccccucgacgaccgguucgccaacgcccugacggcccugaacgacaugggcaagauccgcaaggacauccagcagugggagccguccaagggguggaacgacuggacccaggugcccuucugcagccaccacuuccacgagcucaucaugaaggacggccgggugcuggucgugcccugccgcaaccaggacgagcugaucgggcgggcgcgcaucucccagggcgccggguggagccuccgggagaccgccugccugggcaaguccuacgcccagauguggagccugauguacuuccaccgccgggaccuccgccuggccgcgaacgccaucugcuccgccgugcccagccacugggucccgaccucccggacgaccuggagcauccacgccaagcacgaguggaugaccaccgaggacaugcugaccguguggaaccgcguguggauccgggagaaccccuggauggaggacaagacgcccgucgaguccugggaggagauccccuaccucggcaagcgcgaggaccaguggugcgggagccugaucggccugaccucccgggccaccugggcgaagaacauccaggccgccaucaaccaggugcgcagccucaucgggaacgaggaguacaccgacuacaugccgagcaugaagcgguuccgccgggaggaggaggaggccggcgugcugugguga

SEQ ID NO: 9654 - RNA, 9876 nt, Artificial Sequence
  derived and/or modified CDS sequence (opt1) from DENV-2__FM210243__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagaccuggauccugcgccaccccggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcaguccagcaucaccgaggccgagcugaccggguacggcaccgugacgauggagugcagcccccgcaccggccucgacuucaacgagauggugcugcugcagauggaggacaaggcguggcucguccaccggcagugguuccuggaccugccccuccccuggcugccgggggccgacacccagggcagcaacuggauccagaaggagacccuggugacguucaagaacccccacgccaagaagcaggacguggucgugcucgggucccaggagggcgccaugcacaccgcccugaccggggcgaccgagauccagaugagcagcggcaaccuccuguucacgggccaccugaagugccgccugcggauggacaagcuccagcugaaggggauguccuacagcaugugcaccggcaaguucaagaucgucaaggagaucgccgagacccagcacgggaccaucgugauccgcgugcaguacgagggcgacggcucccccugcaagauccccuucgagaucauggaccuggagaagcggcacguccucgggcgccugaucacggugaacccgaucgugaccgagaaggacagccccgucaacaucgaggccgagccgcccuucggcgacuccuacaucaucaucgggguggagccgggccagcugaagcucaacugguucaagaaggggagcuccaucggccagauguucgagaccaccaugcgcggcgccaagcggauggccauccugggggacacggcgugggacuucggcagccucggcgggguguucaccuccaucgggaaggcccuccaccaggucuucggggccaucuacggcgccgcguucagcgggguguccuggaccaugaagauccugaucggcgugaucaucaccuggaucgggaugaacagccgcuccacgagccuguccgucagccuggugcucgugggcaucaucacccuguaccugggggccaugguccaggccgacuccggcugcguggugagcuggaagaacaaggagcucaagugcggcuccgggaucuucaucaccgacaacguccacaccuggacggagcaguacaaguuccagcccgagagccccagcaagcuggccuccgccauccagaaggcgcacgaggagggcaucugcgggauccggagcgugacccgccuggagaaccucauguggaagcagaucacccccgagcugaaccacauccuguccgagaacgaggugaagcucaccaucaugacgggcgacaucaaggggaucaugcaggccggcaagcggagccugcgcccgcagcccaccgagcugaaguacuccuggaagaccuggggcaaggccaagaugcucagcaccgagucccacaaccagacguuccugaucgacgggcccgagaccgccgagugcccgaacaccaaccgggccuggaacagccuggaggucgaggacuacggcuucgggguguucaccacgaacaucuggcucaagcugcgcgagaagcaggacguguucugcgacuccaagcugaugagcgcggccaucaaggacaaccgggccguccacgccgacaugggcuacuggaucgaguccgcccucaacgacaccuggaagauggagaaggcgagcuucaucgaggugaaguccugccacuggcccaagagccacacccugugguccaacggcgugcuggagagcgagaugaucauccccaaguccuucgccgggcccgucagccagcacaacuaccgcccgggcuacuacacccagaccgccgggcccuggcaccucggcaagcuggagauggacuucgacuucugcgaggggacgaccgugguggucaccgaggacugcggcaaccggggccccagccugcgcaccacgaccgccuccgggaagcucaucaccgaguggugcugccggagcugcacccugcccccgcugcgcuaccggggcgaggacgggugcugguacggcauggagauccgcccccucaaggagaaggaggagaaccuggugaacucccuggugacggcggggcacggccagaucgacaacuucagccucggcguccuggggauggcccuguuccucgaggagaugcugcggacccgcgugggcaccaagcacgccauccugcucgugaccgucuccuucgugacgcugaucaccgggaacaugagcuuccgggaccugggccgcgugauggucauggugggggccgccaugaccgacgacaucggcaugggcgugaccuaccucgcgcugcuggccgccuucaagguccgccccacguucgccgccgggcuccugcugcggaagcucaccuccaaggagcugaugauggcgaccaucggcaucgcccugcucagccaguccaccauccccgagacgauccuggagcugaccgacgcccucgcccuggggaugauggugcugaagaucgugcgcaacauggagaaguaccagcucgccgucaccaucauggcgaucagcugcgugccgaacgccgugauccugcagaacgccuggaaggucuccugcaccauccuggccgcggugagcguguucccccuccugcugacguccagccagcagaaggccgacuggaucccccucgcccugaccaucaagggccugaaccccaccgccaucuuccucaccacgcugucccggaccagcaagaagcgcuccuggccgcugaacgaggccaucauggcggucggcauggugagcauccucgccuccagccugcugaagaacgacauccccaugaccgggccccucgucgccggcgggcugcugaccgugugcuacgugcucacgggccggagcgccgaccuggagcuggagcgcgccaccgacgucaagugggaggaccaggcggagaucuccgggagcucccccauccucagcaucaccaucgccgaggacggcuccaugagcaucaagaacgaggaggaggagcagacccugacgauccugauccggaccggccuccuggugaucuccgggcuguucccggugagcauccccaucaccgccgccgccugguaccucugggaggucaagaagcagcgcgcgggcgugcugugggacgugcccagcccgccgcccgucgggaaggccgagcuggaggacggcgccuaccggaucaagcagaaggggauccucggcuacagccagaucggcgccgggguguacaaggagggcaccuuccacaccauguggcacgugacgcgcggggccguccugaugcaccggggcaagcgcaucgagcccuccugggcggacgugaagaaggaccugaucagcuacgggggcggcuggaagcucgagggggaguggaaggagggcgaggaggugcagguccuggcccuggagcccgggaagaacccccgggccgugcagaccaagcccggccucuucaagaccaacaccgggacgaucggcgccgugucccuggacuucagccccggcaccuccgggagccccaucgucgaccgcaagggcaaggugguggggcuguacggcaacggcgucgugacccgguccggggcguacgugagcgccaucgcccagaccgagaaguccaucgaggacaaccccgagaucgaggacgacaucuuccgcaagaagcggcucacgaucauggaccugcaccccggcgccgggaagaccaagcgcuaccugcccgccaucguccgggaggcgaucaagcgcggccugcggacccucauccuggccccgacccgcgugguggccgccgagauggaggaggcccugcgcgggcuccccauccgguaccagacgcccgcgauccgcgccgagcacaccggccgggagaucgucgaccugaugugccacgccaccuucaccaugcgccugcucagccccgugcgggugccgaacuacaaccugaucaucauggacgaggcccacuucacggaccccgccagcaucgcggcccgcggcuacaucuccacccgggucgagaugggggaggccgccggcaucuucaugaccgcgacgccgcccgggagccgcgacccguucccccaguccaacgcccccaucauggacgaggagcgggagauccccgagcgcagcuggaacuccggccacgagugggugacggacuucaaggggaagaccgugugguucgucccgagcaucaaggccggcaacgacaucgccgccugccugcggaagaacggcaagaaggugauccagcucucccgcaagaccuucgacagcgaguacgugaagacccggacgaacgacugggacuucgucgugaccaccgacaucuccgagaugggggcgaacuucaaggccgagcgcgugaucgacccccggcgcugcaugaagcccgucauccugaccgacggcgaggagcgggugauccuggccgggcccaugccggugacgcacagcuccgccgcccagcgccggggccgcaucgggcgcaaccccaagaacgagaacgaccaguacaucuacaugggcgagccccucgagaacgacgaggacugcgcgcacuggaaggaggccaagaugcugcuggacaacaucaacacccccgagggcaucaucccgagcauguucgagcccgagcgggagaaggucgacgccaucgacggggaguaccgccuccggggcgaggcccgcaagaccuucguggaccugaugcggcgcggggaccugcccguguggcucgccuaccgggucgcggccgagggcaucaacuacgccgaccgccgguggugcuucgacggggugaagaacaaccagauccuggaggagaacguggaggucgagaucuggaccaaggagggcgagcgcaagaagcugaagccgcgguggcucgacgcccgcaucuacuccgacccccuggcgcugaaggaguucaaggaguucgccgccggccggaagucccucacgcugaaccugaucaccgagauggggcgccuccccaccuucaugacccagaaggcccgggacgcccuggacaaccuggcggugcuccacacggccgaggccggcgggcgcgccuacaaccacgcccuguccgagcugcccgagacccucgagacccugcugcuccugacccugcucgcgacggugaccggcggcaucuuccuguuccugaugagcgggaagggcgucgggaagaugacccucggcaugugcugcaucaucaccgccuccauccugcugugguacgcccagauccagccgcacuggaucgccgccagcaucauccucgaguucuuccugaucgugcugcucauccccgagcccgagaagcagcggacgccccaggacaaccagcugacguacgucgugaucgcgauccugaccguggucgccgccaccauggccaacgagaugggguuccucgagaagaccaagaaggaccugggccugggcuccaucgccacgcaggagccggagagcaacauccucgacaucgaccugcgccccgcgagcgccuggacccuguacgccguggccaccaccuucgugacgcccaugcuccggcacuccaucgagaacagcuccgucaacgugagccugaccgcgaucgccaaccaggccaccgugcugauggggcucggcaagggguggccccuguccaagauggacaucggcgucccgcugcucgccaucgggugcuacagccaggugaaccccaucacccugacggccgcgcugcuccugcugguggcccacuacgccaucaucggccccggccuccaggccaaggccacccgcgaggcgcagaagcgggccgccgccgggaucaugaagaaccccaccgucgacggcaucaccgugaucgaccuggacccgauccccuacgaccccaaguucgagaagcagcugggccaggugaugcuccugauccugugcgucacccaggugcucaugaugcgcaccaccugggcccugugcgaggcgcugacccucgccacgggccccaucuccacccugugggaggggaacccgggccgcuucuggaacaccaccaucgccgugagcauggccaacaucuuccggggcuccuaccuggcgggggccggccuccuguucagcaucaugaagaacacgaccaacacccgccgggggaccggcaacaucggcgagacgcugggggagaaguggaagucccgccucaacgcccugggcaagagcgaguuccagaucuacaagaaguccgggauccaggaggucgaccggacccuggccaaggagggcaucaagcgcggggagaccgaccaccacgccgugagccggggcuccgcgaagcuccgcugguucguggagcggaacauggucacccccgagggcaaggugguggaccuggggugcggccgcgggggcuggagcuacuacugcgggggccugaagaacguccgggaggugaagggccucacgaagggcggccccgggcacgaggagcccaucccgauguccaccuacggcuggaaccuggugcgccugcagagcggggucgacguguucuucacgccgcccgagaagugcgacacccuccugugcgacaucggcgaguccagccccaacccgacgaucgaggccggccggacccugcgcgugcucagccuggucgagaacuggcugaacaacgacacccaguucugcaucaaggugcucaaccccuacaugcccuccgugaucgagaagauggagacccugcagcggaaguacgggggcgcccugguccgcaacccgcugagccggaacuccacccacgagauguacugggugagcaacgccacggggaacaucguguccagcgucaacaugaucucccgcaugcucaucaaccgguucaccaugaagcacaagaaggccaccuacgagcccgacguggaccugggcagcgggacccgcaacaucggcaucgaguccgagauccccaaccuggacaucaucggcaagcgcaucgagaagaucaagcaggagcacgagacgagcuggcacuacgaccaggaccaccccuacaagaccugggcguaccacggguccuacgagaccaagcagaccggcagcgccuccagcauggugaacggggucgugcggcuccugacgaagccgugggacgugguccccauggugacccagauggccaugaccgacaccacgcccuucggccagcagcgcguguucaaggagaaggucgacacccggacccaggagcccaaggagggcaccaagaagcugaugaagaucacggccgaguggcucuggaaggagcuggggaagaagaagaccccgcgcaugugcacccgggaggaguucacccgcaaggugcgguccaacgccgcgcugggcgccaucuucacggacgagaacaaguggaaguccgcccgcgaggccguggaggacucccgguucugggagcucgucgacaaggagcgcaaccugcaccuggaggggaagugcgagaccugcguguacaacaugaugggcaagcgggagaagaagcucggggaguucggcaaggcgaagggcagccgcgccaucugguacauguggcugggggcccgguuccuggaguucgaggcccucggcuuccugaacgaggaccacugguucucccgcgagaacagccugagcgggguggagggcgaggggcuccacaagcugggcuacauccugcgggacgucuccaagaaggagggcggggccauguacgcggacgacaccgccggcugggacacccgcaucacgcucgaggaccugaagaacgaggagauggugaccaaccacauggagggggagcacaagaagcuggccgaggccaucuucaagcucaccuaccagaacaaggucgugcgggugcagcgccccacgccccggggcacggucauggacaucaucagccgccgggaccagcgcggguccggccaggugggcaccuacgggcugaacaccuucaccaacauggaggcccagcugauccgccagauggagggcgaggggaucuucaagagcauccagcaccucacggugaccgaggagaucgcgguccagaacuggcuggcccgggugggccgcgagcggcugucccgcauggccaucagcggcgacgacugcguggucaagccccucgacgaccgguucgccuccgcccugaccgcgcugaacgacauggggaaggugcgcaaggacauccagcagugggagccgagccggggcuggaacgacuggacccaggugcccuucugcucccaccacuuccacgagcucaucaugaaggacgggcgcguccugguggugcccugccggaaccaggacgagcugaucggccgcgcccggaucagccagggggccggcuggucccucaaggagacggccugccugggcaagagcuacgcccagauguggucccugauguacuuccaccgccgggaccuccgccuggcggccaacgccaucugcagcgccguccccucccacugggugccgaccagccggaccaccugguccauccacgcgaagcacgaguggaugaccacggaggacaugcugaccguguggaaccgcgucuggauccaggagaaccccuggauggaggacaagacccccguggagagcugggaggaggugcccuaccucgggaagcgggaggaccaguggugcggcagccugaucgggcugaccucccgcgccacgugggccaagaacauccagaccgccaucaaccagguccggagccucaucggcaacgaggaguacaccgacuacaugccguccaugaagcgcuuccgccgggaggaggaggaggccggggugcugugguga

SEQ ID NO: 9655 - RNA, 9876 nt, Artificial Sequence
  derived and/or modified CDS sequence (opt1) from DENV-2__FM210244__SS-prME
accgccggcgugaucaucaugcugauccccaccgccauggcguuccaccucaccacccgcaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgacaucaaggggaucaugcaggccggcaagcggucccugcgcccccagcccaccgagcugaaguacagcuggaagaccuggggcaaggccaagaugcucuccaccgagagccacaaccagacguuccugaucgacgggccggagaccgccgagugccccaacaccaaccgggccuggaacucccuggagguggaggacuacggcuucgggguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggucaagagcugccacuggcccaagucccacacccuguggagcaacggcgugcuggaguccgagaugaucauccccaagagcuucgccgggccggugucccagcacaacuaccgccccggcuacuacacccagaccgccgggcccuggcaccucggcaagcuggagauggacuucgacuucugcgaggggacgaccguggucgugaccgaggacugcggcaaccggggccccagccugcgcaccacgaccgccagcgggaagcucaucaccgaguggugcugccgguccugcacccugccgccccugcgcuaccggggcgaggacgggugcugguacggcauggagauccgcccccucaaggagaaggaggagaaccuggugaacagccuggucacggcggggcacggccagaucgacaacuucucccucggcgugcuggggauggcccuguuccucgaggagaugcugcggacccgcgugggcaccaagcacgccauccugcucgucgccgugagcuucgugacccugaucacggggaacauguccuuccgggaccugggccgcgucauggugauggugggggccgcgaugaccgacgacaucggcaucggcgucaccuaccucgcccugcuggccgccuucaaggugcgccccaccuucgccgcggggcuccugcugcggaagcucacgagcaaggagcugaugauggccaccaucggcaucgcccugcucucccagagcaccaucccggagaccauccuggagcugacggacgcccucgcccuggggaugauggugcugaagaucguccgcaacauggagaaguaccagcucgcggugaccaucauggccaucuccugcgugcccaacgccgucauccugcagaacgccuggaaggugagcugcaccauccuggcgaccguguccgucagcccccuccugcugacguccagccagcagaaggccgacuggaucccccucgcccugaccaucaagggccugaacccgaccgccaucuuccucaccacgcugucccggaccagcaagaagcgcuccuggccccugaacgaggccaucauggcggugggcauggucagcauccucgccuccagccugcugaagaacgacauccccaugaccgggccccucguggccggcgggcugcugaccgugugcuacguccucacgggccggagcgccgaccuggagcuggagcgcgccaccgacgugaagugggaggaccaggcggagaucuccgggagcuccccgauccucagcaucaccaucgccgaggacggcuccaugagcaucaagaacgaggaggaggagcagacccugacgauccugauccggaccggccuccuggugaucuccgggcuguuccccgucagcauccccaucaccgccgccgccugguaccucugggaggugaagaagcagcgcgcgggcgugcugugggacguccccuccccgccgcccguggggaaggccgagcuggaggacggcgccuaccggaucaagcagaaggggauccucggcuacagccagaucggcgccgggguguacaaggagggcaccuuccacaccauguggcacgucacgcgcggggccgugcugaugcaccggggcaagcgcaucgagccguccugggcggacgugaagaaggaccugaucagcuacgggggcggcuggaagcucgagggggaguggaaggagggcgaggagguccaggugcuggcccuggagcccgggaagaacccccgggccgugcagaccaagcccggccucuucaagaccaacaccgggacgaucggcgccgucucccuggacuucagcccgggcaccuccgggagccccaucguggaccgcaagggcaagguggucgggcuguacggcaacggcguggugacccgguccggggcguacgucagcgccaucgcccagaccgagaaguccaucgaggacaaccccgagaucgaggacgacaucuuccgcaagaagcggcucacgaucauggaccugcaccccggcgccgggaagaccaagcgcuaccugccggccaucgugcgggaggcgaucaagcgcggccugcggacccucauccuggcccccacccgcguggucgccgccgagauggaggaggcccugcgcgggcuccccauccgguaccagacgcccgcgauccgcgccgagcacaccggccgggagaucguggaccugaugugccacgccaccuucaccaugcgccugcucagcccggugcggguccccaacuacaaccugaucaucauggacgaggcccacuucacggaccccgccagcaucgcggcccgcggcuacaucuccacccggguggagaugggggaggccgccggcaucuucaugaccgcgacgccgcccgggagcaaggaccccuucccccaguccaacgcccccaucauggacgaggagcgcgagauccccgagcggagcuggaacuccggccacgagugggugacggacuucaaggggaagaccgucugguucgugcccagcaucaaggccggcaacgacaucgccgccugccugcgcaagaacggcaagaaggugauccagcucucccggaagaccuucgacagcgaguacgucaagacccgcacgaacgacugggacuucguggugaccaccgacaucuccgagaugggggcgaacuucaaggccgagcgggucaucgacccccgccggugcaugaagcccgugauccugaccgacggcgaggagcgcgugauccuggccgggccgaugcccgucacgcacagcuccgccgcccagcggcgcggccggaucgggcgcaaccccaagaacgagaacgaccaguacaucuacaugggcgagccccucgagaacgacgaggacugcgcgcacuggaaggaggccaagaugcugcuggacaacaucaacaccccggagggcaucauccccagcauguucgagcccgagcgcgagaagguggacgccaucgacggggaguaccggcuccgcggcgaggcccggaagaccuucguggaccugaugcgccgcggggaccugccggucuggcucgccuaccgcguggcggccgagggcaucaacuacgccgaccggcgcuggugcuucgacggggugaagaacaaccagauccuggaggagaacgucgagguggagaucuggaccaaggagggcgagcggaagaagcugaagccccgcuggcucgacgcccggaucuacuccgacccccuggcgcugaaggaguucaaggaguucgccgccggccgcaagagccucacgcugaaccugaucaccgagauggggcggcuccccaccuucaugacccagaaggcccgcgacgcccuggacaaccuggcggugcuccacacggccgaggccggcgggaaggccuacaaccacgcccuguccgagcugccggagacccucgagacccugcugcuccugacccugcucgcgacggucaccggcggcaucuuccuguuccugaugagcgggaagggcguggggaagaugacccucggcaugugcugcaucaucaccgccuccauccugcuguggcacgcccagauccagccccacuggaucgccgccagcaucauccucgaguucuuccugaucguccugcucauccccgagcccgagaagcagcggaccccgcaggacaaccagcugacguacguggugaucgcgauccugaccgucguggccgccaccauggccaacgagaugggguuccucgagaagaccaagaaggaccugggccugggcuccaucgccacgcaggagcccgagagcaacauccucgacaucgaccugcgccccgcgagcgccuggacccuguacgccguggccaccaccuucgucacgcccaugcuccggcacuccaucgagaacagcuccgugaacgugagccugaccgcgaucgccaaccaggccaccguccugauggggcucggcaagggguggccgcuguccaagauggacaucggcgugccccugcucgccaucgggugcuacagccaggugaaccccaucacccugacggccgcgcugcuccugcuggucgcccacuacgccaucaucggccccggccuccaggccaaggccacccgcgaggcgcagaagcgggccgccgccgggaucaugaagaacccgaccguggacggcaucaccgugaucgaccuggaccccauccccuacgaccccaaguucgagaagcagcuggggcaggucaugcuccugauccugugcgugacccaggugcucaugaugcgcaccaccugggcccugugcgaggcgcugacccucgccacgggcccgaucuccacccugugggaggggaaccccggccgguucuggaacaccaccaucgccgucagcauggccaacaucuuccgcggcuccuaccuggcgggggccggccuccuguucagcaucaugaagaacacgaccaacacccgccgggggaccggcaacaucggcgagacgcugggggagaaguggaagucccgccucaacgcccugggcaagagcgaguuccagaucuacaagaaguccgggauccaggagguggaccggacccuggccaaggagggcaucaagcgcggggagaccgaccaccacgccgugagccggggcuccgcgaagcuccgcugguucgucgagcggaacauggugacccccgagggcaagguggucgaccuggggugcggccgcgggggcuggagcuacuacugcgggggccugaagaacgugcgggaggugaagggccucacgaagggcggccccgggcacgaggagccgauccccauguccaccuacggcuggaaccugguccgccugcagagcgggguggacguguucuucacgccgcccgagaagugcgacacccuccugugcgacaucggcgaguccagcccgaaccccacgaucgaggccggccggacccugcgcguccucagccugguggagaacuggcugaacaacgacacccaguucugcaucaaggugcucaaccccuacaugccguccgucaucgagaagauggagacccugcagcggaaguacgggggcgcccuggugcgcaacccccugagccggaacuccacccacgagauguacugggugagcaacgccacggggaacaucgucuccagcgugaacaugaucucccgcaugcucaucaaccgguucaccaugaagcacaagaaggccaccuacgagcccgacguggaccugggcagcgggacccgcaacaucggcaucgaguccgagaugcccaaccuggacaucaucggcaagcggaucgagaagaucaagcaggagcacgagacgagcuggcacuacgaccaggaccacccguacaagaccugggcguaccacggguccuacgagaccaagcagaccggcagcgccuccagcauggucaacgggguggugcgccuccugacgaagcccugggacgucgugcccauggugacccagauggccaugaccgacaccacgcccuucggccagcagcgcgucuucaaggagaagguggacacccggacccaggagccgaaggagggcaccaagaagcugaugaagaucacggccgaguggcucuggaaggagcuggggaagaagaagacgccccggaugugcacccgggaggaguucacccgcaaggugcgguccaacgccgcgcugggcgccaucuucacggacgagaacaaguggaaguccgcccgcgaggccgucgaggacucccgguucugggagcucguggacaaggagcgcaaccugcaccuggaggggaagugcgagaccugcguguacaacaugaugggcaagcgggagaagaagcucggggaguucggcaaggcgaagggcagccgcgccaucugguacauguggcugggggcccgguuccuggaguucgaggcccucggcuuccugaacgaggaccacugguucucccgcgagaacagccugagcggggucgagggcgaggggcuccacaagcugggcuacauccugcgggacguguccaagaaggagggcggggccauguacgcggacgacaccgccggcugggacacccgcaucacgcucgaggaccugaagaacgaggagauggucaccaaccacauggagggggagcacaagaagcuggccgaggccaucuucaagcucaccuaccagaacaagguggugcggguccagcgccccacgccccggggcacggugauggacaucaucagccgccgggaccagcgcggguccggccaggugggcaccuacgggcugaacaccuucaccaacauggaggcccagcugauccggcagauggagggcgaggggaucuucaagagcauccagcaccucacggucaccgaggagaucgcggugcagaacuggcuggcccgcgugggccgcgagcggcugucccgcauggccaucagcggcgacgacugcgucgugaagccgcucgacgaccgguucgccuccgcccugaccgcgcugaacgacauggggaaggugcgcaaggacauccagcagugggagcccagccggggcuggaacgacuggacccagguccccuucugcucccaccacuuccacgagcucaucaugaaggacgggcgcgugcuggugguccccugccggaaccaggacgagcugaucggccgcgcccggaucagccagggggccggcuggucccucaaggagacggccugccugggcaagagcuacgcccagauguggucccugauguacuuccaccgccgggaccuccgccuggcggccaacgccaucugcagcgccgugccgucccacugggugcccaccagccggaccaccugguccauccacgcgaagcacgaguggaugaccacggaggacaugcugaccgucuggaaccgcguguggauccaggagaaccccuggauggaggacaagacccccguggagagcugggaggaggucccguaccucgggaagcgggaggaccaguggugcggcagccugaucgggcugaccucccgcgccacgugggccaagaacauccagaccgccaucaaccaggugcggagccucaucggcaacgaggaguacaccgacuacaugcccuccaugaagcgcuuccggcgcgaggaggaggaggccggggugcugugguga

SEQ ID NO: 9656 - RNA, 9876 nt, Artificial Sequence
  derived and/or modified CDS sequence (opt1) from DENV-2__FM210234__SS-prME
accgccggggugaucaucaugcugauccccaccgccauggcguuccaccucaccacccggaacggggagccccacaugaucgucgggcggcaggagaagggcaagagccugcuguucaagaccgaggacggggugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggauggggcucgagacccgcaccgagaccuggaugagcuccgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcggccuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccucuucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccggcaaggacucccccgucaacaucgaggccgagcccccguucggggacagcuacaucaucaucggcguggagcccgggcagcugaagcucaacugguucaagaagggcuccagcaucggccagauguucgagaccaccaugcgcggggccaagcggauggccauccugggcgacacggcgugggacuucgggucccugggcgggguguucaccagcaucggcaaggcccuccaccaggucuucggcgccaucuacggggccgcguucuccggcgugagcuggaccaugaagauccugaucggggugaucaucaccuggaucggcaugaacucccgcagcacgucccugagcgucucccuggugcucgugggggucaucacccuguaccugggcgccauggugcaggccgacagcggcugcguggucuccuggaagaacaaggagcucaagugcgggagcggcaucuucaucaccgacaacgugcacaccuggacggagcaguacaaguuccagcccgagucccccagcaagcuggccagcgccauccagaaggcgcacgaggaggggaucugcggcauccgguccgugacccgccuggagaaccucauguggaagcagaucaccccggagcugaaccacauccugagcgagaacgaggucaagcucaccaucaugacgggggacaucaagggcaucaugcaggccggcaagcggucccugcgcccccagcccaccgagcugaaguacagcuggaagaccugggggaaggccaagaugcucuccaccgagagccacaaccagacguuccugaucgacggcccggagaccgccgagugccccaacaccaaccgggccuggaacucccuggagguggaggacuacggguucggcguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggucaagagcugccacuggcccaagucccacacccuguggagcaacggggugcuggaguccgagaugaucauccccaagagcuucgccggcccggugucccagcacaacuaccgccccggguacuacacccagaccgccggccccuggcaccucgggaagcuggagauggacuucgacuucugcgagggcacgaccguggucgugaccgaggacugcggcaaccgggggcccagccugcgcaccacgaccgccagcggcaagcucaucaccgaguggugcugccgguccugcacccugccgccccugcgcuaccgcggggaggacggcugcugguacgggauggagauccgcccccucaaggagaaggaggagaaccuggugaacagccuggucacggcgggccacggccagaucgacaacuucucccucggggugcugggcaucgcccuguuccucgaggagaugcugcggacccgcguggggaccaagcacgccauccugcucgucgccgugagcuucgugacccugaucacgggcaacauguccuuccgggaccuggggcgcgucauggugauggugggcgccgcgaugaccgacgacaucggcaugggggucaccuaccucgcccugcuggccgccuucaaggugcgccccaccuucgccgcgggccuccugcugcggaagcucacgagcaaggagcugaugauggccaccaucgggaucgcccugcucucccagagcaccaucccggagaccauccuggagcugacggacgcccucgcccugggcaugauggugcugaagaucguccgcaacauggagaaguaccagcucgcggugaccaucauggccaucuccugcgugcccaacgccgucauccugcagaacgccuggaaggugagcugcaccauccuggcgaccguguccgucagcccccuccugcugacguccagccagcagaaggccgacuggaucccccucgcccugaccaucaagggccugaacccgaccgccaucuuccucaccacgcugucccggaccagcaagaagcgcuccuggccccugaacgaggccaucauggcgguggggauggucagcauccucgccuccagccugcugaagaacgacauccccaugaccggcccccucguggccgggggccugcugaccgugugcuacguccucacggggcggagcgccgaccuggagcuggagcgcgccaccgacgugaagugggaggaccaggcggagaucuccggcagcuccccgauccucagcaucaccaucgccgaggacggcuccaugagcaucaagaacgaggaggaggagcagacccugacgauccugauccggaccgggcuccuggugaucuccggccuguuccccgucagcauccccaucaccgccgccgccugguaccucugggaggugaagaagcagcgcgcgggggugcugugggacguccccuccccgccgcccgugggcaaggccgagcuggaggacggggccuaccggaucaagcagaagggcauccucggcuacagccagaucggggccggcguguacaaggaggggaccuuccacaccauguggcacgucacgcgcggcgccgugcugaugcaccgggggaagcgcaucgagccguccugggcggacgugaagaaggaccugaucagcuacggcggcggguggaagcucgagggcgaguggaaggagggggaggagguccaggugcuggcccuggagcccggcaagaacccccgggccgugcagaccaagcccggccucuucaagaccaacaccggcacgaucggcgccgucucccuggacuucagcccggggaccuccggcagccccaucguggaccgcaaggggaagguggucggccuguacggcaacgggguggugacccgguccggcgcguacgucagcgccaucgcccagaccgagaaguccaucgaggacaaccccgagaucgaggacgacaucuuccgcaagaagcggcucacgaucauggaccugcaccccggggccggcaagaccaagcgcuaccugccggccaucgugcgggaggcgaucaagcgcgggcugcggacccucauccuggcccccacccgcguggucgccgccgagauggaggaggcccugcgcggccuccccauccgguaccagacgcccgcgauccgcgccgagcacaccggccgggagaucguggaccugaugugccacgccaccuucaccaugcgccugcucagcccggugcggguccccaacuacaaccugaucaucauggacgaggcccacuucacggaccccgccagcaucgcggcccgcggguacaucuccacccggguggagaugggcgaggccgccgggaucuucaugaccgcgacgccgcccggcagccgcgaccccuucccccaguccaacgcccccaucauggacgaggagcgggagauccccgagcgcagcuggaacuccgggcacgagugggugacggacuucaagggcaagaccgucugguucgugcccagcaucaaggccggcaacgacaucgccgccugccugcggaagaacgggaagaaggugauccagcucucccgcaagaccuucgacagcgaguacgucaagacccggacgaacgacugggacuucguggugaccaccgacaucuccgagaugggcgcgaacuucaaggccgagcgcgucaucgacccccggcgcugcaugaagcccgugauccugaccgacggggaggagcgggugauccuggccggcccgaugcccgucacgcacagcuccgccgcccagcgccgggggcgcaucggccgcaaccccaagaacgagaacgaccaguacaucuacaugggcgagccccucgagaacgacgaggacugcgcgcacuggaaggaggccaagaugcugcuggacaacaucaacaccccggaggggaucauccccagcauguucgagcccgagcgggagaagguggacgccaucgacggcgaguaccgccuccgcggggaggcccgcaagaccuucguggaccugaugcggcgcggcgaccugccggucuggcucgccuaccggguggcggccgaggggaucaacuacgccgaccgccgguggugcuucgacggcgugaagaacaaccagauccuggaggagaacgucgagguggagaucuggaccaaggagggcgagcgcaagaagcugaagccccgguggcucgacgcccgcaucuacuccgacccccuggcgcugaaggaguucaaggaguucgccgccgggcgcaagagccucacgcugaaccugaucaccgagaugggccgccuccccaccuucaugacccagaaggcccgggacgcccuggacaaccuggcggugcuccacacggccgaggccgggggccgcgccuacaaccacgcccuguccgagcugccggagacccucgagacccugcugcuccugacccugcucgcgacggucaccggcgggaucuuccuguuccugaugagcggcaagggggugggcaagaugacccucgggaugugcugcaucaucaccgccuccauccugcuguggcacgcccagauccagccccacuggaucgccgccagcaucauccucgaguucuuccugaucguccugcucauccccgagcccgagaagcagcggaccccgcaggacaaccagcugacguacguggugaucgcgauccugaccgucguggccgccaccauggccaacgagaugggcuuccucgagaagaccaagaaggaccugggccugggguccaucgccacgcaggagcccgagagcaacauccucgacaucgaccugcgccccgcgagcgccuggacccuguacgccguggccaccaccuucgucacgcccaugcuccggcacuccaucgagaacagcuccgugaacgugagccugaccgcgaucgccaaccaggccaccguccugaugggccucgggaagggcuggccgcuguccaagauggacaucggggugccccugcucgccaucggcugcuacagccaggugaaccccaucacccugacggccgcgcugcuccugcuggucgcccacuacgccaucaucggccccgggcuccaggccaaggccacccgcgaggcgcagaagcgggccgccgccggcaucaugaagaacccgaccguggacgggaucaccgugaucgaccuggaccccauccccuacgaccccaaguucgagaagcagcugggccaggucaugcuccugauccugugcgugacccaggugcucaugaugcgcaccaccugggcccugugcgaggcgcugacccucgccacggggccgaucuccacccugugggagggcaaccccggccgcuucuggaacaccaccaucgccgucagcauggccaacaucuuccggggguccuaccuggcgggcgccgggcuccuguucagcaucaugaagaacacgaccaacacccgccggggcaccggcaacaucggggagacgcugggcgagaaguggaagucccgccucaacgcccugggcaagagcgaguuccagaucuacaagaaguccggcauccaggagguggaccggacccuggccaaggaggggaucaagcgcggcgagaccgaccaccacgccgugagccggggcuccgcgaagcuccgcugguucgucgagcggaacauggugacccccgaggggaagguggucgaccugggcugcgggcgcggcggguggagcuacuacugcggcggccugaagaacgugcgggaggugaaggggcucacgaagggcgggcccggccacgaggagccgauccccauguccaccuacggguggaaccugguccgccugcagagcggcguggacguguucuucacgccgcccgagaagugcgacacccuccugugcgacaucggcgaguccagcccgaaccccacgaucgaggccgggcggacccugcgcguccucagccugguggagaacuggcugaacaacgacacccaguucugcaucaaggugcucaaccccuacaugccguccgucaucgagaagauggagacccugcagcggaaguacggcggggcccuggugcgcaacccccugagccggaacuccacccacgagauguacugggugagcaacgccacgggcaacaucgucuccagcgugaacaugaucucccgcaugcucaucaaccgguucaccaugaagcacaagaaggccaccuacgagcccgacguggaccuggggagcggcacccgcaacaucggcaucgaguccgagauccccaaccuggacaucaucgggaagcgcaucgagaagaucaagcaggagcacgagacgagcuggcacuacgaccaggaccacccguacaagaccugggcguaccacggcuccuacgagaccaagcagaccgggagcgccuccagcauggucaacggcguggugcggcuccugacgaagcccugggacgucgugcccauggugacccagauggccaugaccgacaccacgcccuucggccagcagcgcgucuucaaggagaagguggacacccggacccaggagccgaaggaggggaccaagaagcugaugaagaucacggccgaguggcucuggaaggagcugggcaagaagaagacgccccggaugugcacccgggaggaguucacccgcaaggugcgguccaacgccgcgcugggggccaucuucacggacgagaacaaguggaaguccgcccgcgaggccgucgaggacucccgguucugggagcucguggacaaggagcgcaaccugcaccuggagggcaagugcgagaccugcguguacaacaugauggggaagcgggagaagaagcucggcgaguucggcaaggcgaaggggagccgcgccaucugguacauguggcugggcgcccgguuccuggaguucgaggcccucggguuccugaacgaggaccacugguucucccgcgagaacagccugagcggcgucgagggggagggccuccacaagcugggcuacauccugcgggacguguccaagaaggagggcggggccauguacgcggacgacaccgccgggugggacacccgcaucacgcucgaggaccugaagaacgaggagauggucaccaaccacauggagggcgagcacaagaagcuggccgaggccaucuucaagcucaccuaccagaacaagguggugcggguccagcgccccacgccccgggggacggugauggacaucaucagccgccgggaccagcgcggcuccggccagguggggaccuacggccugaacaccuucaccaacauggaggcccagcugauccgccagauggagggggagggcaucuucaagagcauccagcaccucacggucaccgaggagaucgcggugcagaacuggcuggcccgggugggccgcgagcggcugucccgcauggccaucagcggggacgacugcgucgugaagccgcucgacgaccgguucgccuccgcccugaccgcgcugaacgacaugggcaaggugcgcaaggacauccagcagugggagcccagccggggguggaacgacuggacccagguccccuucugcucccaccacuuccacgagcucaucaugaaggacggccgcgugcuggugguccccugccggaaccaggacgagcugaucgggcgcgcccggaucagccagggcgccggcuggucccucaaggagacggccugccugggcaagagcuacgcccagauguggucccugauguacuuccaccgccgggaccuccgccuggcggccaacgccaucugcagcgccgugccgucccacugggugcccaccagccggaccaccugguccauccacgcgaagcacgaguggaugaccacggaggacaugcugaccgucuggaaccgcguguggauccaggagaaccccuggauggaggacaagacccccguggagagcugggaggaggucccguaccucggcaagcgggaggaccaguggugcgggagccugaucggccugaccucccgcgccacgugggccaagaacauccagaccgccaucaaccaggugcggagccucaucgggaacgaggaguacaccgacuacaugcccuccaugaagcgcuuccgccgggaggaggaggaggccggcgugcugugguga

SEQ ID NO: 9657 - RNA, 9876 nt, Artificial Sequence
  derived and/or modified CDS sequence (opt1) from DENV-2__FM210213__SS-prME
accgccggcgugaucaucaugcugauccccaccgccauggcguuccaccucaccacccgcaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgacaucaaggggaucaugcaggccggcaagcggucccugcgcccccagcccaccgagcugaaguacagcuggaagaccuggggcaaggccaagaugcucuccaccgagagccacaaccagacguuccugaucgacgggccggagaccgccgagugccccaacaccaaccgggccuggaacucccuggagguggaggacuacggcuucgggguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggucaagagcugccacuggcccaagucccacacccuguggagcaacggcgugcuggaguccgagaugaucauccccaagagcuucgccgggccggugucccagcacaacuaccgccccggcuacuacacccagaccgccgggcccuggcaccucggcaagcuggagauggacuucgacuucugcgaggggacgaccguggucgugaccgaggacugcggcaaccggggccccagccugcgcaccacgaccgccagcgggaagcucaucaccgaguggugcugccgguccugcacccugccgccccugcgcuaccggggcgaggacgggugcugguacggcauggagauccgcccccucaaggagaaggaggagaaccuggugaacagccuggucacggcggggcacggccagaucgacaacuucucccucggcgugcuggggauggcccuguuccucgaggagaugcugcggacccgcgugggcaccaagcacgccauccugcucgucgccgugagcuucgugacccugaucacggggaacauguccuuccgggaccugggccgcgucauggugauggugggggccgcgaugaccgacgacaucggcaugggcgucaccuaccucgcccugcuggccgccuucaaggugcgccccaccuucgccgcggggcuccugcugcggaagcucacgagcaaggagcugaugauggccaccaucggcaucgcccugcucucccagagcaccaucccggagaccauccuggagcugacggacgcccucgcccuggggaugauggugcugaagaucguccgcaacauggagaaguaccagcucgcggugaccaucauggccaucuccugcgugcccaacgccgucauccugcagaacgccuggaaggugagcugcaccauccuggcgaccguguccgucagcccccuccugcugacguccagccagcagaaggccgacuggaucccccucgcccugaccaucaagggccugaacccgaccgccaucuuccucaccacgcugucccggaccagcaagaagcgcuccuggccccugaacgaggccaucauggcggugggcauggucagcauccucgccuccagccugcugaagaacgacauccccaugaccgggccccucguggccggcgggcugcugaccgugugcuacguccucacgggccggagcgccgaccuggagcuggagcgcgccaccgacgugaagugggaggaccaggcggagaucuccgggagcuccccgauccucagcaucaccaucgccgaggacggcuccaugagcaucaagaacgaggaggaggagcagacccugacgauccugauccggaccggccuccuggugaucuccgggcuguuccccgucagcauccccaucaccgccgccgccugguaccucugggaggugaagaagcagcgcgcgggcgugcugugggacguccccuccccgccgcccguggggaaggccgagcuggaggacggcgccuaccggaucaagcagaaggggauccucggcuacagccagaucggcgccgggguguacaaggagggcaccuuccacaccauguggcacgucacgcgcggggccgugcugaugcaccggggcaagcgcaucgagccguccugggcggacgugaagaaggaccugaucagcuacgggggcggcuggaagcucgagggggaguggaaggagggcgaggagguccaggugcuggcccuggagcccgggaagaacccccgggccgugcagaccaagcccggccucuucaagaccaacaccgggacgaucggcgccgucucccuggacuucagcccgggcaccuccgggagccccaucguggaccgcaagggcaagguggucgggcuguacggcaacggcguggugacccgguccggggcguacgucagcgccaucgcccagaccgagaaguccaucgaggacaaccccgagaucgaggacgacaucuuccgcaagaagcggcucacgaucauggaccugcaccccggcgccgggaagaccaagcgcuaccugccggccaucgugcgggaggcgaucaagcgcggccugcggacccucauccuggcccccacccgcguggucgccgccgagauggaggaggcccugcgcgggcuccccauccgguaccagacgcccgcgauccgcgccgagcacaccggccgggagaucguggaccugaugugccacgccaccuucaccaugcgccugcucagcccggugcggguccccaacuacaaccugaucaucauggacgaggcccacuucacggaccccgccagcaucgcggcccgcggcuacaucuccacccggguggagaugggggaggccgccggcaucuucaugaccgcgacgccgcccgggagccgcgaccccuucccccaguccaacgcccccaucauggacgaggagcgggagauccccgagcgcagcuggaacuccggccacgagugggugacggacuucaaggggaagaccgucugguucgugcccagcaucaaggccggcaacgacaucgccgccugccugcggaagaacggcaagaaggugauccagcucucccgcaagaccuucgacagcgaguacgucaagacccggacgaacgacugggacuucguggugaccaccgacaucuccgagaugggggcgaacuucaaggccgagcgcgucaucgacccccggcgcugcaugaagcccgugauccugaccgacggcgaggagcgggugauccuggccgggccgaugcccgucacgcacagcuccgccgcccagcgccggggccgcaucgggcgcaaccccaagaacgagaacgaccaguacaucuacaugggcgagccccucgagaacgacgaggacugcgcgcacuggaaggaggccaagaugcugcuggacaacaucaacaccccggagggcaucauccccagcauguucgagcccgagcgggagaagguggacgccaucgacggggaguaccgccuccggggcgaggcccgcaagaccuucguggaccugaugcggcgcggggaccugccggucuggcucgccuaccggguggcggccgagggcaucaacuacgccgaccgccgguggugcuucgacggggugaagaacaaccagauccuggaggagaacgucgagguggagaucuggaccaaggagggcgagcgcaagaagcugaagccccgguggcucgacgcccgcaucuacuccgacccccuggcgcugaaggaguucaaggaguucgccgccggccgcaagagccucacgcugaaccugaucaccgagauggggcgccuccccaccuucaugacccagaaggcccggaacgcccuggacaaccuggcggugcuccacacggccgaggccggcgggcgcgccuacaaccacgcccuguccgagcugccggagacccucgagacccugcugcuccugacccugcucgcgacggucaccggcggcaucuuccuguuccugaugagcgggaagggcguggggaagaugacccucggcaugugcugcaucaucaccgccuccauccugcuguggcacgcccagauccagccccacuggaucgccgccagcaucauccucgaguucuuccugaucguccugcucauccccgagcccgagaagcagcggaccccgcaggacaaccagcugacguacguggugaucgcgauccugaccgucguggccgccaccauggccaacgagaugggguuccucgagaagaccaagaaggaccugggccugggcuccaucgccacgcaggagcccgagagcaacauccucgacaucgaccugcgccccgcgagcgccuggacccuguacgccguggccaccaccuucgucacgcccaugcuccggcacuccaucgagaacagcuccgugaacgugagccugaccgcgaucgccaaccaggccaccguccugauggggcucggcaagggguggccgcuguccaagauggacaucggcgugccccugcucgccaucgggugcuacagccaggugaaccccaucacccugacggccgcgcugcuccugcuggucgcccacuacgccaucaucggccccggccuccaggccaaggccacccgcgaggcgcagaagcgggccgccgccgggaucaugaagaacccgaccguggacggcaucaccgugaucgaccuggaccccauccccuacgaccccaaguucgagaagcagcuggggcaggucaugcuccugauccugugcgugacccaggugcucaugaugcgcaccaccugggcccugugcgaggcgcugacccucgccacgggcccgaucuccacccugugggaggggaaccccggccgcuucuggaacaccaccaucgccgucagcauggccaacaucuuccggggcuccuaccuggcgggggccggccuccuguucagcaucaugaagaacacgaccaacacccgccgggggaccggcaacaucggcgagacgcugggggagaaguggaagucccgccucaacgcccugggcaagagcgaguuccagaucuacaagaaguccgggauccaggagguggaccggacccuggccaaggagggcaucaagcgcggggagaccgaccaccacgccgugagccggggcuccgcgaagcuccgcugguucgucgagcggaacauggugacccccgagggcaagguggucgaccuggggugcggccgcgggggcuggagcuacuacugcgggggccugaagaacgugcgggaggugaagggccucacgaagggcggccccgggcacgaggagccgauccccauguccaccuacggcuggaaccugguccgccugcagagcgggguggacguguucuucacgccgcccgagaagugcgacacccuccugugcgacaucggcgaguccagcccgaaccccacgaucgaggccggccggacccugcgcguccucagccugguggagaacuggcugaacaacgacacccaguucugcaucaaggugcucaaccccuacaugccguccgucaucgagaagauggagacccugcagcggaaguacgggggcgcccuggugcgcaacccccugagccggaacuccacccacgagauguacugggugagcaacgccacggggaacaucgucuccagcgugaacaugaucucccgcaugcucaucaaccgguucaccaugaagcacaagaaggccaccuacgagcccgacguggaccugggcagcgggacccgcaacaucggcaucgaguccgagauccccaaccuggacaucaucggcaagcgcaucgagaagaucaagcaggagcacgagacgagcuggcacuacgaccaggaccacccguacaagaccugggcguaccacggguccuacgagaccaagcagaccggcagcgccuccagcauggucaacgggguggugcggcuccugacgaagcccugggacgucgugcccauggugacccagauggccaugaccgacaccacgcccuucggccagcagcgcgucuucaaggagaagguggacacccggacccaggagccgaaggagggcaccaagaagcugaugaagaucacggccgaguggcucuggaaggagcuggggaagaagaagacgccccggaugugcacccgggaggaguucacccgcaaggugcgguccaacgccgcgcugggcgccaucuucacggacgagaacaaguggaaguccgcccgcgaggccgucgaggacucccgguucugggagcucguggacaaggagcgcaaccugcaccuggaggggaagugcgagaccugcguguacaacaugaugggcaagcgggagaagaagcucggggaguucggcaaggcgaagggcagccgcgccaucugguacauguggcugggggcccgguuccuggaguucgaggcccucggcuuccugaacgaggaccacugguucucccgcgagaacagccugagcggggucgagggcgaggggcuccacaagcugggcuacauccugcgggacguguccaagaaggagggcggggccauguacgcggacgacaccgccggcugggacacccgcaucacgcucgaggaccugaagaacgaggagauggucaccaaccacauggagggggagcacaagaagcuggccgaggccaucuucaagcucaccuaccagaacaagguggugcggguccagcgccccacgccccggggcacggugauggacaucaucagccgccgggaccagcgcggguccggccaggugggcaccuacgggcugaacaccuucaccaacauggaggcccagcugauccgccagauggagggcgaggggaucuucaagagcauccagcaccucacggucaccgaggagaucgcggugcagaacuggcuggcccgggugggccgcgagcggcugucccgcauggccaucagcggcgacgacugcgucgugaagccgcucgacgaccgguucgccuccgcccugaccgcgcugaacgacauggggaaggugcgcaaggacauccagcagugggagcccagccggggcuggaacgacuggacccagguccccuucugcucccaccacuuccacgagcucaucaugaaggacgggcgcgugcuggugguccccugccggaaccaggacgagcugaucggccgcgcccggaucagccagggggccggcuggucccucaaggagacggccugccugggcaagagcuacgcccagauguggucccugauguacuuccaccgccgggaccuccgccuggcggccaacgccaucugcagcgccgugccgucccacugggugcccaccagccggaccaccugguccauccacgcgaagcacgaguggaugaccacggaggacaugcugaccgucuggaaccgcguguggauccaggagaaccccuggauggaggacaagacccccguggagagcugggaggaggucccguaccucgggaagcgggaggaccaguggugcggcagccugaucgggcugaccucccgcgccacgugggccaagaacauccagaccgccaucaaccaggugcggagccucaucggcaacgaggaguacaccgacuacaugcccuccaugaagcgcuuccgccgggaggaggaggaggccggggugcugugguga

SEQ ID NO: 9658 - RNA, 9876 nt, Artificial Sequence
  derived and/or modified CDS sequence (opt1) from DENV-2__FM210235__SS-prME
accgccggcgugaucaucaugcugauccccaccgccauggcguuccaccucaccacccggaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucagcaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugccggcacuccaugguggaccgcggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccggaccggccucgacuucaacgagauggugcugcugcagauggaggacaaggcguggcucguccaccgccagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccggcugcgcauggacaagcuccagcugaaggggaugagcuacuccaugugcaccggcaaguucaagaucgucaaggagaucgccgagacccagcacgggaccaucgugauccgggugcaguacgagggcgacggcagccccugcaagaucccguucgagaucauggaccuggagaagcgccacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcggggcgccaagcgcauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccggagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgcuccgugacccggcuggagaaccucauguggaagcagaucaccccggagcugaaccacauccugagcgagaacgaggucaagcucaccaucaugacgggcgacaucaaggggaucaugcaggccggcaagcgcucccugcggccccagcccaccgagcugaaguacagcuggaagaccuggggcaaggccaagaugcucuccaccgagagccacaaccagacguuccugaucgacgggccggagaccgccgagugccccaacaccaaccgcgccuggaacucccuggagguggaggacuacggcuucgggguguucaccacgaacaucuggcucaagcugcgggagaagcaggacgucuucugcgacagcaagcugauguccgcggccaucaaggacaaccgcgccgugcacgccgacaugggcuacuggaucgagagcgcccucaacgacaccuggaagauggagaaggcguccuucaucgaggucaagagcugccacuggcccaagucccacacccuguggagcaacggcgugcuggaguccgagaugaucauccccaagagcuucgccgggccggugucccagcacaacuaccggcccggcuacuacacccagaccgccgggcccuggcaccucggcaagcuggagauggacuucgacuucugcgaggggacgaccguggucgugaccgaggacugcggcaaccgcggccccagccugcggaccacgaccgccagcgggaagcucaucaccgaguggugcugccgcuccugcacccugccgccccugcgguaccgcggcgaggacgggugcugguacggcauggagauccggccccucaaggagaaggaggagaaccuggugaacagccuggucacggcggggcacggccagaucgacaacuucucccucggcgugcuggggauggcccuguuccucgaggagaugcugcgcacccgggugggcaccaagcacgccauccugcucgucaccgugagcuucgugacgcugaucaccgggaacauguccuuccgcgaccugggccgcgucauggugauggugggggccgccaugaccgacgacaucggcaugggcgucaccuaccucgcgcugcuggccgccuucaaggugcggcccacguucgccgccgggcuccugcugcgcaagcucaccagcaaggagcugaugauggcgaccaucggcaucgcccugcucucccagagcaccaucccggagacgauccuggagcugaccgacgcccucgcccuggggaugauggugcugaagaucguccggaacauggagaaguaccagcucgccgugaccaucauggcgaucuccugcgugcccaacgccgucauccugcagaacgccuggaaggugagcugcaccauccuggccgcgguguccgucagcccccuccugcugacguccagccagcagaaggccgacuggaucccccucgagugguccaucaagggccugaacccgaccgccaucuuccugaccacccucagccgcacguccaagaagcggagcuggccccugaacgaggccaucauggccgugggcauggucuccauccuggcgagcagccuccugaagaacgacauccccaugaccgggccccugguggccggcgggcuccugaccgugugcuacguccugaccggccgcuccgccgaccucgagcuggagcgggccacggacgugaagugggaggaccaggccgagaucagcggguccagcccgauccuguccaucaccaucgcggaggacggcagcauguccaucaagaacgaggaggaggagcagacccucaccauccugauccgcacgggccugcucgugaucagcgggcuguuccccgucuccauccccaucaccgccgccgccugguaccugugggaggugaagaagcagcgggccggcgugcucugggacguccccagcccgccgcccguggggaaggcggagcuggaggacggcgccuaccgcaucaagcagaaggggauccugggcuacucccagaucggcgccgggguguacaaggagggcaccuuccacaccauguggcacgucacccgcggggccgugcucaugcaccgcggcaagcggaucgagccgagcugggccgacgugaagaaggaccugaucuccuacgggggcggcuggaagcuggagggggaguggaaggagggcgaggagguccaggugcucgcgcuggagcccgggaagaacccccgcgccgugcagacgaagcccggccuguucaagaccaacaccgggaccaucggcgccgucagccucgacuucuccccgggcacgagcgggucccccaucguggaccggaagggcaagguggucgggcuguacggcaacggcguggugacccgcagcggggccuacgucuccgcgaucgcccagaccgagaaguccaucgaggacaaccccgagaucgaggacgacaucuuccggaagaagcgccugaccaucauggaccuccaccccggcgccgggaagacgaagcgguaccugccggccaucgugcgcgaggccaucaagcggggccugcgcacccugauccucgcgcccacccgcguggucgccgccgagauggaggaggcccugcgggggcugcccauccgcuaccagacccccgccauccgggcggagcacacgggccgcgagaucguggaccucaugugccacgccaccuucaccaugcggcugcugagcccggugcgcguccccaacuacaaccucaucaucauggacgaggcccacuucaccgaccccgccuccaucgccgcgcggggcuacaucagcacgcgcguggagaugggggaggccgccggcaucuucaugaccgccacgccgcccgggucccgggaccccuucccccagagcaacgcgcccaucauggacgaggagcgcgagauccccgagcgguccuggaacagcggccacgagugggugaccgacuucaaggggaagacggucugguucgugcccuccaucaaggccggcaacgacaucgccgccugccugcgcaagaacggcaagaaggugauccagcugagccggaagaccuucgacuccgaguacgucaagacccgcaccaacgacugggacuucguggugacgaccgacaucagcgagaugggggccaacuucaaggcggagcgggucaucgacccccgccggugcaugaagcccgugauccucaccgacggcgaggagcgcgugauccuggccgggccgaugcccgucacccacuccagcgccgcccagcggcgcggccgcaucgggcggaaccccaagaacgagaacgaccaguacaucuacaugggcgagccccuggagaacgacgaggacugcgcccacuggaaggaggcgaagaugcuccuggacaacaucaacacgccggagggcaucauccccuccauguucgagcccgagcgcgagaagguggacgccaucgacggggaguaccggcugcgcggcgaggcccggaagaccuucguggaccucaugcgccgcggggaccugccggucuggcuggccuaccgcguggccgcggagggcaucaacuacgccgaccggcgcuggugcuucgacggggugaagaacaaccagauccucgaggagaacgucgagguggagaucuggaccaaggagggcgagcggaagaagcugaagccccgcuggcuggacgcccggaucuacagcgacccccucgcccugaaggaguucaaggaguucgcggccggccgcaagucccugacccucaaccugaucacggagauggggcggcugcccaccuucaugacccagaaggcccgcgacgcccucgacaaccuggccgugcugcacaccgcggaggccggcgggcgggccuacaaccacgcccucagcgagcugccggagacgcuggagacccuccugcugcucacccugcuggccaccgucacgggcggcaucuuccucuuccugauguccgggaagggcguggggaagaugacccugggcaugugcugcaucaucaccgcgagcauccuccugugguacgcccagauccagccccacuggaucgccgccuccaucauccuggaguucuuccucaucguccugcugauccccgagcccgagaagcagcgcaccccgcaggacaaccagcucaccuacguggugaucgccauccugacggucguggcggccaccauggccaacgagaugggguuccuggagaagaccaagaaggaccucggccugggcagcaucgccacccgggagcccgagagcaacauccuggacaucgaccuccgccccgccuccgcguggacgcuguacgccguggccaccaccuucgucacccccaugcugcggcacagcaucgagaacuccagcgugaacgugucccucacggccaucgcgaaccaggccaccguccugauggggcugggcaagggguggccgcucagcaagauggacaucggcgugccccugcuggccaucgggugcuacucccaggugaaccccaucacccucaccgccgcccugcugcuccuggucgcgcacuacgccaucaucggccccggccugcaggccaaggccacgcgcgaggcccagaagcgcgcggccgccgggaucaugaagaacccgaccguggacggcgugaccgucaucgaccucgaccccauccccuacgaccccaaguucgagaagcagcugggccaggugaugcugcucauccugugcgugacccagguccugaugaugcggacgaccugggcccucugcgaggcccugacccuggcgaccggcccgaucagcacgcucugggaggggaaccccggccgcuucuggaacaccaccaucgccguguccauggccaacaucuuccggggcagcuaccuggccggggcgggccuccuguucuccaucaugaagaacaccacgaacacccgccgggggaccggcaacaucggcgagacccugggggagaaguggaagucccgccugaacgcccucggcaaguccgaguuccagaucuacaagaaguccgggauccaggagguggaccggacgcuggccaaggagggcaucaagcgcggggagaccgaccaccacgccgucucccggggcagcgccaagcugcgcugguucguggagcggaacauggugacccccgagggcaaggucguggaccucgggugcggccgcgggggcugguccuacuacugcgggggccugaagaacgugcgggaggucaagggccugaccaagggcgggcccgggcacgaggagccgauccccaugagcacguacggcuggaaccucgugcgccugcaguccgggguggacgucuucuucacgccgcccgagaagugcgacacccugcucugcgacaucggcgagagcagcccgaaccccaccaucgaggcgggccggacgcugcgcgugcugucccucguggagaacuggcugaacaacgacacccaguucugcaucaagguccugaaccccuacaugccgagcgugaucgagaagauggagacccuccagcggaaguacgggggcgcccuggugcgcaacccccugucccggaacagcacccacgagauguacugggucuccaacgccaccgggaacaucgugagcuccgugaacaugaucagccgcaugcugaucaaccgcuucacgaugaagcacaagaaggccaccuacgagcccgacgucgaccucggcuccgggacccggaacaucggcaucgagagcgagauccccaaccuggacaucaucggcaagcgcaucgagaagaucaagcaggagcacgagaccuccuggcacuacgaccaggaccacccguacaagacgugggccuaccacgggagcuacgagaccaagcagaccggcuccgcgagcuccauggugaacggggugguccggcugcucaccaagcccugggacguggugcccauggucacgcagauggccaugaccgacaccacccccuucggccagcagcgcguguucaaggagaagguggacacgcggacccaggagccgaaggagggcaccaagaagcugaugaagaucaccgccgaguggcuguggaaggagcucgggaagaagaagacgccccgcaugugcacccgggaggaguucacccgcaagguccggagcaacgccgcccugggcgcgaucuucaccgacgagaacaaguggaaguccgcccgcgaggccguggaggacagccgguucugggagcugguggacaaggagcgcaaccuccaccuggaggggaagugcgagacgugcgucuacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgagaacagccuguccgggguggagggcgaggggcugcacaagcucggcuacauccugcgggacgucagcaagaaggagggcggggccauguacgccgacgacaccgcgggcugggacacccgcaucacccuggaggaccucaagaacgaggagauggugacgaaccacauggagggggagcacaagaagcuggccgaggccaucuucaagcugaccuaccagaacaaggugguccgggugcagcgccccacgccccggggcaccgugauggacaucaucucccgccgcgaccagcgggggagcggccaggucggcacguacgggcucaacaccuucaccaacauggaggcccagcugauccgccagauggagggcgaggggguguucaaguccauccagcggcugaccgugacggaggagaucgccguccagaacuggcucgcgcgcgugggccgggagcgccugagccggauggccaucuccggcgacgacugcguggucaagccgcuggacgaccgcuucgccagcgcccucaccgcccugaacgacauggggaaggugcggaaggacauccagcagugggagcccucccgcggcuggaacgacuggacccaggugcccuucugcagccaccacuuccacgagcugaucaugaaggacgggcggguccucguggugcccugccgcaaccaggacgagcugaucggccgggcgcgcaucucccagggggccggcuggagccugaaggagaccgccugccucggcaaguccuacgcccagauguggagccugauguacuuccaccggcgcgaccugcggcucgccgcgaacgccaucugcuccgccgucccgagccacugggugcccacgucccgcaccaccuggagcauccacgccaagcacgaguggaugaccaccgaggacaugcugacgguguggaaccgggucuggauccaggagaaccccuggauggaggacaagacccccguggagagcugggaggaggugccguaccuggggaagcgcgaggaccaguggugcggcucccucaucgggcugaccagccgcgcgaccugggccaagaacauccagacggccaucaaccagguccggucccugaucggcaacgaggaguacaccgacuacaugcccagcaugaagcgcuuccggcgcgaggaggaggaggccggggugcucugguga

SEQ ID NO: 9659 - RNA, 9876 nt, Artificial Sequence
  derived and/or modified CDS sequence (opt1) from DENV-2__FM210205__SS-prME
agcgcggggaugaucaucaugcugauccccaccgugauggccuuccaccucaccacccggaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccggcgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccucuucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcucaagaagcugaccuccaaggagcugaugaugaccacgaucgggaucguccuccugagccaguccaccauccccgagaccgugcuggagcucaccgacgcccuggcgcugggcaugauggugcucaagaucguccggaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcgcagcuggccgcugaacgaggccaucauggcggucggcaugguguccauccuggccagcucccuccugaagaacgacauccccaugaccggcccccugguggccgggggccuccugaccgucugcuacgugcugaccgggcggagcgccgaccucgagcuggagcgcgccacggacgugaagugggaggaccaggcggagaucuccggcagcagccccauccuguccaucaccaucagcgaggacggguccaugagcaucaagaacgaggaggaggagcagacccucaccauccugauccggacgggccugcucgucaucuccggccuguucccgaucagcauccccaucaccgccgccgccugguaccugugggaggugaagaagcagcgcgccggggugcucugggacguccccagcccgccgcccaugggcaaggcggagcuggaggacggggccuaccggaucaagcagaagggcauccugggguacagccagaucggcgccggcguguacaaggaggggaccuuccacaccauguggcacgugacccgcggcgccguccucaugcacaaggggaagcggaucgagcccuccugggccgacgugaagaaggaccugaucagcuacggcgggggcuggaagcuggagggcgaguggaaggagggggaggaggugcagguccucgcgcuggagcccggcaagaacccccgcgccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgguccggcgccuacgugagcgccaucgcgcagaccgagaaguccaucgaggacaaccccgagaucgaggacgacaucuuccgcaagcggcgccugaccaucauggaccugcaccccggggccggcaagacgaagcgguaccuccccgccaucgugcgcgaggccaucaagcgggggcugcgcacccugauccucgcgccgacccgggucguggccgccgagauggaggaggcccugcgcggccugcccauccgguaccagacccccgccauccgcgcggagcacacggggcgggagaucguggaccucaugugccacgccaccuucaccaugcgccugcugagccccguccgcgugccgaacuacaaccucaucaucauggacgaggcccacuucaccgaccccgccuccaucgccgcgcggggcuacaucagcacgcgcguggagaugggcgaggccgccgggaucuucaugaccgccacgccgcccggcagccgggacccguucccccaguccaacgcccccaucaucgacgaggagcgcgagauccccgagcggagcuggaacuccgggcacgagugggucaccgacuucaagggcaagacggugugguucgugccgagcaucaaggcggggaacgacaucgccgccugccugcgcaagaacggcaagaaggucauccagcugucccggaagaccuucgacagcgaguacgugaagacccgcaccaacgacugggacuucguggucacgaccgacaucuccgagaugggcgccaacuucaaggcggagcgggugaucgacccccgccggugcaugaagcccgugauccucaccgacggggaggagcgcgucauccuggccggccccaugccggugacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgggagaagguggacgccaucgacggcgaguaccgccugcgcggggaggcccgcaagaccuucgucgaccucaugcgccggggcgaccugcccguguggcuggccuacaagguggccgcggaggggaucaacuacgccgaccgccgguggugcuucgacggcaucaagaacaaccagauccucgaggagaacgucgagguggagaucuggaccaaggagggggagcgcaagaagcugaagccgcgguggcuggacgcccgcaucuacuccgacccccucgcccugaaggaguucaaggaguucgccgcgggccggaagucccugacccucaaccugaucacggagaugggccgccugcccaccuucaugacccagaagacccgggacgcccucgacaaccuggccguccugcacacggccgaggccggcgggcgcgccuacaaccacgcccucuccgagcugcccgagacccuggagacccuccugcugcucacccugcuggccacggugaccgggggcaucuuccucuuccugaugagcggccgggggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcgcacgccccaggacaaccagcucacguacgucgugaucgccauccugaccguggucgccgcgaccauggccaacgagaugggcuuccuggagaagaccaagaaggacuucgggcucggcuccaucgccacgcagcagccggagagcaacauccuggacaucgaccugcggcccgccuccgccuggacccucuacgcgguggccaccaccuucgugacgcccaugcugcgccacagcaucgagaacagcuccgucaacgugagccugaccgccaucgccaaccaggccaccgugcucaugggccuggggaagggcuggccccuguccaagauggacaucggggucccgcuccuggcgaucggcugcuacagccaggugaaccccaucacccugacggccgcccuccugcugcucguggcccacuacgcgaucaucgggcccggccugcaggccaaggccacccgggaggcccagaagcgcgccgcggccggcaucaugaagaaccccaccgucgacgggaucaccgugaucgaccuggacccgauccccuacgaccccaaguucgagaagcagcucggccaggugaugcugcugauccucugcgucacccaggugcugaugaugcggaccaccugggcccugugcgaggcccucacccuggccacggggcccaucuccacccugugggagggcaacccggggcgcuucuggaacaccaccaucgcggugagcauggccaacaucuuccggggcuccuaccucgccggcgccgggcugcuguucagcaucaugaagaacacgaccaacacccgccggggcaccgggaacaucggcgagacgcucggcgagaaguggaagucccgccugaacgcccugggcaagagcgaguuccagaucuacaagaaguccggcauccaggaggucgaccgcacccucgcgaaggaggggaucaagcggggcgagaccgaccaccacgccgugagccgcggguccgccaagcugcggugguucguggagcgcaacauggucacccccgagggcaaggugguggaccugggcugcgggcggggcggguggagcuacuacugcggcgggcucaagaacguccgcgaggugaagggccugacgaagggcgggcccggccacgaggagcccaucccgauguccaccuacggguggaaccuggugcggcuccagagcggcgucgacguguucuucaucccgcccgagaagugcgacacccugcugugcgacaucggggaguccagccccaacccgaccguggaggccggccgcacgcuccggguccugaaccugguggagaacuggcucaacaacaacacccaguucugcaucaaggugcugaaccccuacaugcccuccgucaucgagaagauggaggcgcugcagcgcaaguacggcggggcccuggugcggaacccgcucagccgcaacagcacccacgagauguacuggguguccaacgccagcggcaacaucgucuccagcgugaacaugaucucccggaugcugaucaaccgcuucaccaugcggcacaagaaggccaccuacgagcccgacguggaccuggggagcggcacgcgcaacaucgggaucgaguccgagauccccaaccucgacaucaucggcaagcggaucgagaagaucaagcaggagcacgagaccagcuggcacuacgaccaggaccaccccuacaagaccugggccuaccacggcuccuacgagaccaagcagacggggagcgcguccagcauggucaacggcguggugcgccugcugaccaagccgugggacguccuccccaccgugacccagauggccaugacggacaccacccccuucgggcagcagcggguguucaaggagaaggucgacacccgcacgcaggagcccaaggagggcaccaagaagcugaugaagaucaccgccgaguggcuguggaaggagcucggcaagaagaagaccccgcgcaugugcacgcgggaggaguucacccgcaaggugcgguccaacgccgcccugggggcgaucuucaccgacgagaacaaguggaaguccgcccgcgaggccguggaggacucccgguucugggagcuggucgacaaggagcgcaaccuccaccuggagggcaagugcgagaccugcguguacaacaugauggggaagcgggagaagaagcugggcgaguucgggaaggccaagggcagccgcgccaucugguacauguggcucggcgcgcgguuccuggaguucgaggcccugggguuccucaacgaggaccacugguucucccgcgagaacagccuguccggcgucgagggggagggccugcacaagcucggguacauccugcgggacgugagcaagaaggagggcggcgccauguacgccgacgacacggcggggugggacacccgcaucacccuggaggaccucaagaacgaggagauggugaccaaccacauggagggcgagcacaagaagcuggccgaggccaucuucaagcugacguaccagaacaaggucgugcgggugcagcgccccacgccccgggggaccgucauggacaucaucagccgccgggaccagcgcggcuccggccagguggggaccuacggccucaacacguucaccaacauggaggcccagcugauccggcagauggagggggagggcguguucaagaacauccagcaccugaccgucaccgaggagguggccgugcagaacuggcucgcgcgcgucgggcgggagcgccugagccgcauggccaucuccggcgacgacugcguggugaagccccuggacgaccgguucgccaacgcccucacggcccugaacgacaugggcaagauccgcaaggacauccagcagugggagccgagcaagggguggaacgacuggacccagguccccuucugcucccaccacuuccacgagcugaucaugaaggacggccgggugcucgugguccccugccgcaaccaggacgagcugaucgggcgggcgcgcaucagccagggcgccggguggucccugcgggagaccgccugccucggcaagagcuacgcccagauguggucccugauguacuuccaccgccgggaccugcgccucgccgcgaacgccaucugcagcgccgugcccucccacugggugccgaccagccggacgaccugguccauccacgccaagcacgaguggaugaccaccgaggacaugcugaccgucuggaaccgcguguggauccgggagaaccccuggauggaggacaagacgcccguggagagcugggaggagauccccuaccugggcaagcgcgaggaccaguggugcgggucccucaucggccugaccagccgggccaccugggcgaagaacauccaggccgccaucaaccagguccgcucccugaucgggaacgaggaguacaccgacuacaugccgagcaugaagcgguuccgccgggaggaggaggaggccggcgugcucugguga

SEQ ID NO: 9660 - RNA, 9876 nt, Artificial Sequence
  derived and/or modified CDS sequence (opt1) from DENV-2__FM210206__SS-prME
agcgcgggcaugaucaucaugcugauccccaccgugauggccuuccaccucaccacccggaacggggagccgcacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacgcggaccgagaccuggauguccagcgagggggccuggaagcacgcccagcgcaucgagaccuggauccugcggcaccccggcuucacgcugauggccgcgauccucgccuacaccaucgggaccacccacuuccagcgcguccugaucuucauccugcucacggccguggcccccuccaugaccaugcggugcaucggcaucagcaaccgcgacuucguggagggcgucuccgggggcagcuggguggacaucgugcuggagcacggguccugcgucaccaccauggcgaagaacaagcccacgcuggacuucgagcucaucaagaccgaggccaagcagcccgccacccugcggaaguacugcaucgaggccaagcugaccaacacgaccaccgagagccgcugcccgacccagggcgagcccucccucaaggaggagcaggacaagcgguucgugugcaagcacagcaugguggaccgcggcugggggaacggcugcgggcuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcucaccggguacggcaccgucacgauggagugcagcccccggaccggccuggacuucaacgagauggugcugcuccagauggagaacaaggccuggcuggugcaccgccagugguuccuggaccucccccugcccuggcugccgggggccgacaagcaggaguccaacuggauccagaaggagacccucgucaccuucaagaacccccacgccaagaagcaggacguggucgugcugggcagccaggagggggcgaugcacacggcccugaccggcgccaccgagauccagaugagcuccgggaaccuccuguucaccggccaccugaagugccggcuccgcauggacaagcugcagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccucgagaagcgcuacguccugggccggcugaucaccgugaacccgaucgugacggagaaggacucccccgucaacaucgaggccgagccgcccuucggggacagcuacaucaucaucggcguggagccggggcagcucaagcugaacugguucaagaagggcuccagcaucgggcagauguucgagaccaccaugcgcggcgcgaagcgcauggccauccugggcgacaccgccugggacuucgggucccucggcgggguguucacgagcaucggcaaggcccugcaccaggucuucggggccaucuacggcgcggccuucuccggcgugagcuggaccaugaagauccugaucggggugaucaucaccuggaucggcaugaacucccggagcaccucccugagcgucucccucgugcugguggggaucgucacgcuguaccucggcgugauggugcaggccgacagcgggugcgucguguccuggaagaacaaggagcugaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcucgagaaccugauguggaagcagaucacccccgagcugaaccacauccucgccgagaacgaggugaagcugaccaucaugaccggggacaucaagggcaucaugcaggccgggaagcgcagccugcggccgcagcccacggagcucaaguacuccuggaagaccuggggcaaggccaagaugcugagcaucgaguccuacaaccagaccuuccugaucgacggccccgagaccgcggagugcccgaacacgaaccgcgccuggaacagccucgagguggaggacuacggguucggcgucuucaccaccaacaucuggcugaagcugaaggagaagcaggacgccuucugcgacuccaagcucaugagcgccgccaucaaggacaaccgggcggugcacgccgacaugggguacuggaucgaguccgcccugaacgacaccuggaagaucgagaaggccagcuucaucgaggugaagaacugccacuggcccaagucccacacgcuguggagcaacggcguccucgaguccgagaugaucauccccaagaaccuggccggccccgugagccagcacaacuaccgcccgggguaccacacccagaucgcgggccccuggcaccuggggaagcucgagauggacuucgacuucugcgacggcaccaccgugaucgucaccgaggacugcgggaaccggggccccucccugcgcacgaccaccgccagcggcaagcugaucaccgaguggugcugccggagcugcacgcucccgccccugcgcuaccgcggggaggacggcugcugguacgggauggagauccgcccccugaaggagaaggaggagaaccucgugaacucccuggugaccgccggccacgggcaggucgacaacuucagccugggcgugcucggcauggcccuguuccuggaggagaugcuccggacccgcguggggaccaagcacgcgauccugcuggucgccguguccuucgugacgcucaucaccggcaacaugagcuucaaggaccuggggcgggucguggugauggucggcgccaccauggccgacgacaucgggaugggcgugaccuaccuggcccuccuggcggccuucaaggugcgccccacguucgccgccggccugcuccugcggaagcugaccuccaaggagcucaugaugaccaccaucgggaucguccugcugagccaguccacgauccccgagaccgugcucgagcugaccgacgcccuggcgcucggcaugauggugcugaagaucguccgcaacauggagaaguaccagcuggccgugaccaucauggccauccucugcguccccaacgccgugauccugcagaacgccuggaaggugagcugcacgauccuggcggucguguccgugagcccccuccugcugaccuccagccagcagaagaccgacuggaucccccucgcccugaccaucaaggggcugaaccccacggccaucuuccucaccacccugucccgcaccaacaagaagcggagcuggccgcugaacgaggccaucauggcggucggcaugguguccauccucgccagcucccugcugaagaacgacauccccaugacgggcccccucguggccgggggccugcugaccgucugcuacgugcucaccgggcgcagcgccgaccuggagcuggagcgggccaccgacgugaagugggaggaccaggcggagaucuccggcagcagccccauccucuccaucacgaucagcgaggacggguccaugagcaucaagaacgaggaggaggagcagacccugaccauccugauccgcaccggccuccuggucaucuccggccuguucccgaucagcauccccaucacggccgccgccugguaccucugggaggugaagaagcagcgggccggggugcugugggacguccccagcccgccgcccaugggcaaggcggagcuggaggacggggccuaccgcaucaagcagaagggcauccucggguacagccagaucggcgccggcguguacaaggaggggaccuuccacaccauguggcacgugacccggggcgccguccugaugcacaaggggaagcgcaucgagcccuccugggccgacgugaagaaggaccugaucagcuacggcgggggcuggaagcucgagggcgaguggaaggagggggaggaggugcagguccuggcgcuggagcccggcaagaacccccgggccgugcagaccaagcccggccucuucaagacgaacaccggcaccaucggggccgugucccuggacuucagccccggcaccuccggcagccccaucaucgacaagaaggggaaggucgugggccuguacgggaacggcguggucacgcgcuccggcgccuacgugagcgccaucgcgcagaccgagaaguccaucgaggacaaccccgagaucgaggacgacaucuuccggaagcgccggcugaccaucauggaccuccaccccggggccggcaagaccaagcgcuaccugcccgccaucgugcgggaggccaucaagcgcgggcugcggacgcucauccuggcgccgacccgcgucguggccgccgagauggaggaggcccugcggggccuccccauccgcuaccagacccccgccauccgggcggagcacaccgggcgcgagaucguggaccugaugugccacgccacguucaccaugcgccugcucagccccguccgggugccgaacuacaaccugaucaucauggacgaggcccacuucaccgaccccgccuccaucgccgcgcgcggcuacaucagcacccggguggagaugggcgaggccgccgggaucuucaugacggccacgccgcccggcagccgcgacccguucccccaguccaacgcccccaucaucgacgaggagcgggagauccccgagcgcagcuggaacuccgggcacgagugggucaccgacuucaagggcaagaccgugugguucgugccgagcaucaaggcggggaacgacaucgccgccugccugcggaagaacggcaagaaggucauccagcucucccgcaagacguucgacagcgaguacgugaagacccggaccaacgacugggacuucguggucaccacggacaucuccgagaugggcgccaacuucaaggcggagcgcgugaucgacccccggcgcugcaugaagcccgugauccugaccgacggggaggagcgggucauccuggccggccccaugccggugacccacagcuccgccgcccagcgccgggggcgcaucggccggaaccccaagaacgagaacgaccaguacaucuacaugggggagccccucgagaacgacgaggacugcgcccacuggaaggaggcgaagaugcugcuggacaacaucaacacccccgagggcaucaucccgagcauguucgagcccgagcgcgagaagguggacgccaucgacggcgaguaccggcuccgcggggaggcccgcaagacguucgucgaccugaugcggcgcggcgaccugcccguguggcucgccuacaagguggccgcggaggggaucaacuacgccgaccggcgcuggugcuucgacggcaucaagaacaaccagauccuggaggagaacgucgagguggagaucuggaccaaggagggggagcggaagaagcugaagccgcgcuggcucgacgcccggaucuacuccgacccccuggcccugaaggaguucaaggaguucgccgcgggccgcaagagccucacccugaaccugaucaccgagaugggccggcuccccacguucaugacccagaagacccgcgacgcccuggacaaccuggccguccuccacaccgccgaggccggcgggcgggccuacaaccacgcccuguccgagcugcccgagacgcucgagacccugcugcuccugacccugcucgccaccgugaccgggggcaucuuccuguuccugaugagcggccgcgggaucggcaagaugacccucgggaugugcugcaucaucaccgccuccauccugcugugguacgcgcagauccagccgcacuggaucgccgccagcaucauccucgaguucuuccugaucgugcugcucauccccgagcccgagaagcagcggacgccccaggacaaccagcugaccuacgucgugaucgccauccugacgguggucgccgcgaccauggccaacgagaugggcuuccucgagaagaccaagaaggaccuggggcugggcuccaucgccacccagcagccggagagcaacauccucgacaucgaccugcgccccgccuccgccuggacgcuguacgcgguggccaccaccuucgugacccccaugcuccggcacagcaucgagaacagcuccgucaacgugagccugacggccaucgccaaccaggccaccgugcugaugggccucgggaagggcuggccccuguccaagauggacaucggggucccgcugcucgcgaucggcugcuacagccaggugaaccccaucacccugaccgccgcccugcuccugcugguggcccacuacgcgaucaucgggcccggccuccaggccaaggccacgcgcgaggcccagaagcgggccgcggccggcaucaugaagaaccccaccgucgacgggaucaccgugaucgaccuggacccgauccccuacgaccccaaguucgagaagcagcugggccaggugaugcuccugauccugugcgucacccaggugcucaugaugcgcacgaccugggcccugugcgaggcccugacccucgccaccgggcccaucuccacgcugugggagggcaacccggggcgguucuggaacaccaccaucgcggugagcauggccaacaucuuccgcggcuccuaccuggccggcgccgggcuccuguucagcaucaugaagaacaccacgaacacccggcgcggcaccgggaacaugggcgagacccugggcgagaaguggaagucccgccucaacgcccugggcaagagcgaguuccagaucuacaagaaguccgggauccaggaggucgaccggacgcuggcgaaggaggggaucaagcgcggcgagaccgaccaccacgccgugagccggggguccgccaagcuccgcugguucguggagcggaacauggucacccccgagggcaaggugguggaccugggcugcgggcgcggcggguggagcuacuacugcggcgggcugaagaacguccgggaggugaagggccucaccaagggcgggcccggccacgaggagcccaucccgauguccacguacggguggaaccuggugcgccugcagagcggcgucgacguguucuucaucccgcccgagaagugcgacacccuccugugcgacaucggggaguccagccccaacccgaccguggaggccggccggacccugcgcguccucaaccugguggagaacuggcugaacaacaacacgcaguucugcaucaaggugcugaaccccuacaugcccuccgucaucgagaagauggaggcgcuccagcggaaguacggcggggcccuggugcgcaacccgcugagccggaacagcacccacgagauguacuggguguccaacgccagcggcaacaucgucuccagcgugaacaugaucucccgcaugcucaucaaccgguucaccaugcgccacaagaaggccaccuacgagcccgacguggaccuggggagcggcacccggaacaucgggaucgaguccgagauccccaaccuggacaucaucggcaagcgcaucgagaagaucaagcaggagcacgagacgagcuggcacuacgaccaggaccaccccuacaagaccugggccuaccacggcuccuacgagaccaagcagaccgggagcgcguccagcauggucaacggcguggugcggcuccugacgaagccgugggacguccugcccaccgugacccagauggccaugaccgacacgacccccuucgggcagcagcgcguguucaaggagaaggucgacacccgcacccaggagcccaaggagggcacgaagaagcucaugaagaucaccgccgaguggcuguggaaggagcugggcaagaagaagaccccgcggaugugcacccgcgaggaguucacgcggaaggugcgcuccaacgccgcccucggggcgaucuucaccgacgagaacaaguggaaguccgcccgggaggccguggaggacucccgcuucugggagcuggucgacaaggagcggaaccugcaccucgagggcaagugcgagaccugcguguacaacaugauggggaagcgcgagaagaagcugggcgaguucgggaaggccaagggcagccgggccaucugguacauguggcugggcgcgcgcuuccucgaguucgaggcccugggguuccugaacgaggaccacugguucucccgggagaacagccucuccggcgucgagggggagggccugcacaagcugggguacauccuccgcgacgugagcaagaaggagggcggcgccauguacgccgacgacaccgcggggugggacacgcggaucacccuggaggaccugaagaacgaggagauggugaccaaccacauggagggcgagcacaagaagcucgccgaggccaucuucaagcugaccuaccagaacaaggucgugcgcgugcagcggcccacgccccgcgggaccgucauggacaucaucagccggcgcgaccagcggggcuccggccagguggggaccuacggccugaacaccuucacgaacauggaggcccagcucauccgccagauggagggggagggcguguucaagaacauccagcaccugaccgucaccgaggagguggccgugcagaacuggcuggcgcgggucgggcgcgagcgccucagccggauggccaucuccggcgacgacugcguggugaagccccuggacgaccgcuucgccaacgcccugaccgcccucaacgacaugggcaagauccggaaggacauccagcagugggagccgagcaagggguggaacgacuggacgcagguccccuucugcucccaccacuuccacgagcugaucaugaaggacggccgcgugcuggugguccccugccggaaccaggacgagcucaucgggcgcgcgcggaucagccagggcgccggguggucccugcgcgagaccgccugccugggcaagagcuacgcccagauguggucccucauguacuuccaccggcgcgaccugcggcuggccgcgaacgccaucugcagcgccgugcccucccacugggugccgaccagccgcaccacgugguccauccacgccaagcacgaguggaugaccaccgaggacaugcucaccgucuggaaccggguguggauccgcgagaaccccuggauggaggacaagacccccguggagagcugggaggagauccccuaccugggcaagcgggaggaccaguggugcgggucccugaucggccucacgagccgcgccaccugggcgaagaacauccaggccgccaucaaccagguccggucccugaucgggaacgaggaguacaccgacuacaugccgagcaugaagcgcuuccggcgcgaggaggaggaggccggcgugcugugguga

SEQ ID NO: 9661 - RNA, 9876 nt, Artificial Sequence
  derived and/or modified CDS sequence (opt1) from DENV-2__FM210246__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuucaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacaugggcgagacgcugggcgagaaguggaagucccgccugaacgcccucgggaaguccgaguuccagaucuacaagaaguccggcauccaggaggucgaccggacccuggcgaaggaggggaucaagcgcggcgagaccgaccaccacgccgugagccggggguccgccaagcugcgcugguucguggagcggaacauggucacccccgagggcaaggugguggaccucggcugcgggcgcggcggguggagcuacuacugcggcgggcugaagaacguccgggaggugaagggccugacgaagggcgggcccggccacgaggagcccaucccgauguccaccuacggguggaaccucgugcgccugcagagcggcgucgacguguucuucaucccgcccgagaagugcgacacccugcucugcgacaucggggaguccagccccaacccgaccguggaggccggccggacgcugcgcguccugaaccucguggagaacuggcugaacaacaacacccaguucugcaucaaggugcugaaccccuacaugcccuccgucaucgagaagauggaggcgcugcagcggaaguacggcggggcccucgugcgcaacccgcugagccggaacagcacccacgagauguacuggguguccaacgccagcggcaacaucgucuccagcgugaacaugaucucccgcaugcugaucaaccgguucaccaugcgccacaagaaggccaccuacgagcccgacguggaccucgggagcggcacgcggaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggucaacggcguggugcggcugcucaccaagccgugggacguccugcccaccgugacccagauggccaugacggacaccacccccuucgggcagcagcgcguguucaaggagaaggucgacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcuccaacgccgcccugggggcgaucuucaccgacgagaacaaguggaaguccgcccgggaggccguggaggacucccgcuucugggagcucgucgacaaggagcggaaccugcaccuggagggcaagugcgagaccugcguguacaacaugauggggaagcgcgagaagaagcucggcgaguucgggaaggccaagggcagccgggccaucugguacauguggcugggcgcgcgcuuccuggaguucgaggcccucggguuccugaacgaggaccacugguucucccgggagaacagccuguccggcgucgagggggagggccuccacaagcugggguacauccugcgcgacgugagcaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggucgugcgcgugcagcggcccacgccccgggggaccgucauggacaucaucagccggcgcgaccagcggggcuccggccagguggggaccuacggccugaacacguucaccaacauggaggcccagcugauccgccagauggagggggagggcguguucaagaacauccagcaccucaccgucaccgaggagguggccgugaagaacuggcuggcgcgggucgggcgcgagcgccugagccggauggccaucuccggcgacgacugcguggugaagccccucgacgaccgcuucgccaacgcccugacggcccugaacgacaugggcaagauccggaaggacauccagcagugggagccgagcaagggguggaacgacuggacccagguccccuucugcucccaccacuuccacgagcucaucaugaaggacggccgcgugcuggugguccccugccggaaccaggacgagcugaucgggcgcgcgcggaucagccagggcgccggguggucccuccgcgagaccgccugccugggcaagagcuacgcccagauguggucccugauguacuuccaccggcgcgaccuccggcuggccgcgaacgccaucugcagcgccgugcccucccacugggugccgaccagccgcacgaccugguccauccacgccaagcacgaguggaugaccaccgaggacaugcugaccgucuggaaccggguguggauccgcgagaaccccuggauggaggacaagacgcccguggagagcugggaggagauccccuaccucggcaagcgggaggaccaguggugcgggucccugaucggccugaccagccgcgccaccugggcgaagaacauccaggccgccaucaaccagguccggucccucaucgggaacgaggaguacaccgacuacaugccgagcaugaagcgcuuccggcgcgaggaggaggaggccggcgugcugugguga

SEQ ID NO: 9662 - RNA, 9876 nt, Artificial Sequence
  derived and/or modified CDS sequence (opt1) from DENV-2__FM210207__SS-prME
agcgcgggcaugaucaucaugcugauccccaccgugauggccuuccaccucaccacccgcaacggggagccccacaugaucgucggcauccaggagaaggggaagucccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccuccaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcguccucaucuucauccugcugacggccguggcccccuccaugaccaugcggugcaucggcaucagcaaccgcgacuucguggagggcgucuccgggggcagcuggguggacaucgugcucgagcacggguccugcgucaccaccauggcgaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgugugcaagcacagcaugguggaccgcggcugggggaacggcugcggccuguucggcaagggcgggaucgucacgugcgccauguucacgugcaagaagaacauggagggcaagaucgugcagcccgagaaccuggaguacaccaucguggucacgccccacuccggggaggagcacgcggugggcaacgacacggggaagcacggcaaggagaucaaggugaccccgcagagcuccaucaccgaggccgagcugaccggguacggcaccgucacgauggagugcagcccccggaccggccucgacuucaacgagauggugcugcugcagauggagaacaaggccuggcucgugcaccgccagugguuccuggaccugccccuccccuggcugccgggggccgacaagcaggaguccaacuggauccagaaggagacccuggucaccuucaagaacccccacgccaagaagcaggacguggucgugcucggcagccaggagggggcgaugcacacggcccugaccggcgccaccgagauccagaugagcuccgggaaccuccuguucaccggccaccugaagugccggcugcgcauggacaagcuccagcugaagggcaugagcuacuccaugugcacggggaaguucaagguggucaaggagaucgccgagacccagcacggcaccaucgugauccgggugcaguacgagggggacggcagccccugcaagauccccuucgagaucauggaccuggagaagcgcuacguccucggccggcugaucaccgugaacccgaucgugacggagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgcgaagcgcauggccauccugggcgacaccgccugggacuucgggucccugggcgggguguucacgagcaucggcaaggcccuccaccaggucuucggggccaucuacggcgcggccuucuccggcgugagcuggaccaugaagauccugaucggggugaucaucaccuggaucggcaugaacucccggagcaccucccugagcgucucccuggugcucguggggaucgucacgcuguaccugggcgugauggugcaggccgacagcgggugcgucguguccuggaagaacaaggagcucaagugcggcagcggcaucuucaucaccgacaacgugcacaccuggaccgagcaguacaaguuccagcccgagagccccuccaagcuggccagcgcgauccagaaggcccaggaggaggggaucugcggcauccgcuccgucacgcggcuggagaaccucauguggaagcagaucacccccgagcugaaccacauccuggccgagaacgaggugaagcucaccaucaugaccggggacaucaagggcaucaugcaggccgggaagcgcagccugcggccgcagcccacggagcugaaguacuccuggaagaccuggggcaaggccaagaugcucagcaccgaguccuacaaccagaccuuccugaucgacggccccgagacggcggagugcccgaacaccaaccgcgccuggaacagccuggagguggaggacuacggguucggcgucuucaccaccaacaucuggcucaagcugaaggagaagcaggacgccuucugcgacuccaagcugaugagcgccgccaucaaggacaaccgggcggugcacgccgacaugggguacuggaucgaguccgcccucaacgacacguggaagaucgagaaggccagcuucaucgaggugaagaacugccacuggcccaagucccacacccuguggagcaacggcguccuggaguccgagaugaucauccccaagaaccucgccggccccgugagccagcacaacuaccgcccgggguaccacacccagaucgcgggccccuggcaccuggggaagcuggagauggacuucgacuucugcgacggcaccaccgugaucgucacggaggacugcgggaaccggggccccucccuccgcaccaccaccgccagcggcaagcugaucacggaguggugcugccggagcugcacccugcccccgcuccgcuaccgcggggaggacggcugcugguacgggauggagauccgcccccugaaggagaaggaggagaaccuggugaacucccucgugaccgccggccacgggcaggucgacaacuucagccugggcgugcugggcauggcccucuuccuggaggagaugcugcggacccgcguggggacgaagcacgcgauccuccuggucgccguguccuucgugacccugaucaccggcaacaugagcuucaaggaccucgggcgggucguggugauggucggcgccaccauggccgacgacaucgggaugggcgugacguaccuggcccugcucgcggccuucaaggugcgccccaccuucgccgccggccugcugcuccggaagcugaccuccaaggagcugaugaugaccacgaucgggaucguccuccugagccaguccaccauccccgagaccgugcuggagcucaccgacgcccuggcgcugggcaugauggugcucaagaucguccgcaacauggagaaguaccagcuggccgugacgaucauggccauccugugcgucccgaacgccgugauccuccagaacgccuggaaggugagcugcaccauccuggcggucguguccgugagcccccugcuccugaccuccagccagcagaagaccgacuggaucccccuggcccucacgaucaaggggcugaaccccaccgccaucuuccugaccacccucucccgcacgaacaagaagcggagcuggccgcugaacgaggccaucauggcggucggcaugguguccauccuggccagcucccuccugaagaacgacauccccaugaccggcccccugguggccgggggccuccugaccgucugcuacgugcugaccgggcgcagcgccgaccucgagcuggagcgggccacggacgugaagugggaggaccaggcggagaucuccggcagcagccccauccuguccaucaccaucagcgaggacggguccaugagcaucaagaacgaggaggaggagcagacccucaccauccugauccgcacgggccugcucgucaucuccggccuguucccgaucagcauccccaucaccgccgccgccugguaccugugggaggugaagaagcagcgggccggggugcucugggacguccccagcccgccgcccaugggcaaggcggagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggccgacgugaagaaggaccugaucagcuacggcgggggcuggaagcuggagggcgaguggaaggagggggaggaggugcagguccucgcgcuggagcccggcaagaacccccgggccgugcagacgaagcccgggcuguucaagaccaacaccggcaccaucggggccgugucccucgacuucagccccggcacguccggcagccccaucaucgacaagaaggggaaggucgugggccuguacgggaacggcguggucacccgcuccggcgccuacgugagcgccaucgcgcagaccgagaaguccaucgaggacaaccccgagaucgaggacgacaucuuccggaagcgccggcugaccaucauggaccugcaccccggggccggcaagacgaagcgcuaccuccccgccaucgugcgggaggccaucaagcgcgggcugcggacccugauccucgcgccgacccgcgucguggccgccgagauggaggaggcccugcggggccugcccauccgcuaccagacccccgccauccgggcggagcacacggggcgcgagaucguggaccucaugugccacgccaccuucaccaugcgccugcugagccccguccgggugccgaacuacaaccucaucaucauggacgaggcccacuucaccgaccccgccuccaucgccgcgcgcggcuacaucagcacgcggguggagaugggcgaggccgccgggaucuucaugaccgccacgccgcccggcagccgcgacccguucccccaguccaacgcccccaucaucgacgaggagcgggagauccccgagcgcagcuggaacuccgggcacgagugggucaccgacuucaagggcaagacggugugguucgugccgagcaucaaggcggggaacgacaucgccgccugccugcggaagaacggcaagaaggucauccagcugucccgcaagaccuucgacagcgaguacgugaagacccggaccaacgacugggacuucguggucacgaccgacaucuccgagaugggcgccaacuucaaggcggagcgcgugaucgacccccggcgcugcaugaagcccgugauccucaccgacggggaggagcgggucauccuggccggccccaugccggugacccacagcuccgccgcccagcgccgggggcgcaucggccggaaccccaagaacgagaacgaccaguacaucuacaugggggagccccuggagaacgacgaggacugcgcccacuggaaggaggcgaagaugcuccuggacaacaucaacacgcccgagggcaucaucccgagcauguucgagcccgagcgcgagaagguggacgccaucgacggcgaguaccggcugcgcggggaggcccgcaagaccuucgucgaccucaugcggcgcggcgaccugcccguguggcuggccuacaagguggccgcggaggggaucaacuacgccgaccggcgcuggugcuucgacggcaucaagaacaaccagauccucgaggagaacgucgagguggagaucuggaccaaggagggggagcggaagaagcugaagccgcgcuggcuggacgcccggaucuacuccgacccccucgcccugaaggaguucaaggaguucgccgcgggccgcaagagccugacccucaaccugaucacggagaugggccggcugcccaccuucaugacccagaagacccgcgacgcccucgacaaccuggccguccugcacacggccgaggccggcgggcgggccuacaaccacgcccucuccgagcugcccgagacccuggagacccuccugcugcucacccugcuggccacggugaccgggggcaucuuccucuuccugaugagcggccgcgggaucggcaagaugacccuggggaugugcugcaucaucaccgccuccauccuccugugguacgcgcagauccagccgcacuggaucgccgccagcaucauccuggaguucuuccucaucgugcugcugauccccgagcccgagaagcagcggacgccccaggacaaccagcucacguacgucgugaucgccauccugaccguggucgccgcgaccauggccaacgagaugggcuuccuggagaagaccaagaaggaccucgggcugggcuccaucgccacgcagcagccggagagcaacauccuggacaucgaccuccgccccgccuccgccuggacccuguacgcgguggccaccaccuucgugacgcccaugcugcggcacagcaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacccucacggccgcccugcugcuccugguggcccacuacgcgaucaucgggcccggccugcaggccaaggccacccgcgaggcccagaagcgggccgcggccggcaucaugaagaaccccaccgucgacgggaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacggggcccaucuccacccucugggagggcaacccggggcgguucuggaacaccaccaucgcggugagcauggccaacaucuuccgcggcuccuaccuggccggcgccgggcuccucuucagcaucaugaagaacacgaccaacacccggcgcggcaccgggaacaugggcgagacgcugggcgagaaguggaagucccgccugaacgcccucgggaagaacgaguuccagaucuacaagaaguccggcauccaggaggucgaccggacccuggcgaaggaggggaucaagcgcggcgagaccgaccaccacgccgugucccgggggagcgccaagcugcgcugguucguggagcggaacauggucacccccgagggcaaggugguggaccucggcugcgggcgcggcgggugguccuacuacugcggcgggcugaagaacguccgggaggugaagggccugacgaagggcgggcccggccacgaggagcccaucccgaugagcaccuacggguggaaccucgugcgccugcaguccggcgucgacguguucuucaucccgcccgagaagugcgacacccugcucugcgacaucggggagagcucccccaacccgaccguggaggccggccggacgcugcgcguccugaaccucguggagaacuggcugaacaacaacacccaguucugcaucaaggugcugaaccccuacaugcccagcgucaucgagaagauggaggcgcugcagcggaaguacggcggggcccucgugcgcaacccgcugucccggaacagcacccacgagauguacugggugagcaacgccuccggcaacaucgucagcuccgugaacaugaucagccgcaugcugaucaaccgguucaccaugcgccacaagaaggccaccuacgagcccgacguggaccucggguccggcacgcggaacaucgggaucgagagcgagauccccaaccuggacaucaucggcaagcgcaucgagaagaucaagcaggagcacgagaccuccuggcacuacgaccaggaccaccccuacaagaccugggccuaccacggcagcuacgagaccaagcagacgggguccgcgagcuccauggucaacggcguggugcggcugcucaccaagccgugggacguccugcccaccgugacccagauggccaugacggacaccacccccuucgggcagcagcgcguguucaaggagaaggucgacacccgcacgcaggagcccaaggagggcaccaagaagcugaugaagaucaccgccgaguggcucuggaaggagcugggcaagaagaagaccccgcggaugugcacgcgcgaggaguucacccggaaggugcgcagcaacgccgcccugggggcgaucuucaccgacgagaacaaguggaaguccgcccgggaggccguggaggacagccgcuucugggagcucgucgacaaggagcggaaccugcaccuggagggcaagugcgagaccugcguguacaacaugauggggaagcgcgagaagaagcucggcgaguucgggaaggccaagggcucccgggccaucugguacauguggcugggcgcgcgcuuccuggaguucgaggcccucggguuccugaacgaggaccacugguucagccgggagaacucccugagcggcgucgagggggagggccuccacaagcugggguacauccugcgcgacguguccaagaaggagggcggcgccauguacgccgacgacacggcggggugggacacccggaucacccucgaggaccugaagaacgaggagauggugaccaaccacauggagggcgagcacaagaagcuggccgaggccaucuucaagcucacguaccagaacaaggucgugcgcgugcagcggcccacgccccgggggaccgucauggacaucaucagccggcgcgaccagcggggcagcggccagguggggaccuacggccugaacacguucaccaacauggaggcccagcugauccgccagauggagggggagggcguguucaagaacauccagcaccucaccgucaccgaggagguggccgugcagaacuggcuggcgcgggucgggcgcgagcgccugucccggauggccaucagcggcgacgacugcguggugaagccccucgacgaccgcuucgccaacgcccugacggcccugaacgacaugggcaagauccggaaggacauccagcagugggagccguccaagggguggaacgacuggacccagguccccuucugcagccaccacuuccacgagcucaucaugaaggacggccgcgugcuggugguccccugccggaaccaggacgagcugaucgggcgcgcgcggaucucccagggcgccggguggagccuccgcgagaccgccugccugggcaaguccuacgcccagauguggagccugauguacuuccaccggcgcgaccuccggcuggccgcgaacgccaucugcuccgccgugcccagccacugggugccgaccucccgcacgaccuggagcaugcacgccaagcacgaguggaugaccaccgaggacaugcugaccgucuggaaccggguguggauccgcgagaaccccuggauggaggacaagacgcccguggaguccugggaggagauccccuaccucggcaagcgggaggaccaguggugcgggagccugaucggccugaccucccgcgccaccugggcgaagaacauccaggccgccaucaaccagguccggagccucaucgggaacgaggaguacaccgacuacaugccguccaugaagcgcuuccggcgcgaggaggaggaggccggcgugcugugguga

SEQ ID NO: 9663 - RNA, 9876 nt, Artificial Sequence
  derived and/or modified CDS sequence (opt1) from DENV-2__FM210238__SS-prME
accgccggcaugaucaucaugcugauccccaccgccauggcguuccaccucaccacccgcaacggggagccccacaugaucgugggccggcaggagaagggcaagagccugcuguucaagaccgaggacggcgucaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccguggcccuggucccccacguggggaugggccucgagacccgcaccgagaccuggaugagcuccgagggggccuggaagcacgcccagcggaucgagaccuggauccugcgccacccgggcuucaccaucauggcggccauccuggccuacaccguggggaccacccacuuccagcgggcccucaucuucauccugcuggcggccgucgcccccagcaugaccaugcgcugcaucggcaucuccaaccgggacuucguggagggcgugagcgggggcuccugggucgacaucgugcucgagcacgggagcugcgugaccaccauggccaagaacaagcccacgcuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgucugcaagcacuccaugguggaccggggcugggggaacggcugcgggcuguucggcaagggcgggaucgugacgugcgccauguucacgugcaagaagaacauggagggcaagaucguccagcccgagaaccuggaguacaccaucgugaucacgccccacagcggggaggagcacgccgugggcaacgacacggggaagcacggcaaggagaucaagaucaccccgcagucccccaucaccgaggccgagcugaccggguacggcaccgucacgauggagugcagcccccgcaccggccucgacuucaacgagauggugcugcugcagauggaggacaaggcguggcucgugcaccggcagugguuccuggaccugccccucccguggcugcccggggccgacacccagggcuccaacuggauccagaaggagacccuggucacguucaagaacccccacgccaagaagcaggacguggugguccucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgugaaggagaucgccgagacccagcacgggaccaucgucauccgcgugcaguacgagggcgacggcagccccugcaagaucccguucgagaucauggaccuggagaagcggcacgugcucgggcgccugaucacggucaaccccaucgugaccgagaaggacucccccgugaacaucgaggccgagcccccguucggcgacagcuacaucaucaucggggucgagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccagguguucggggccaucuacggcgccgcguucuccggggucagcuggaccaugaagauccugaucggcgugaucaucaccuggaucgggaugaacucccgcagcacgucccugagcgugucccugguccucgugggcgugaucacccuguaccugggggccaugguccaggccgacagcggcugcgugguguccuggaagaacaaggagcucaagugcggcagcgggaucuucaucaccgacaacguccacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggugaagcucaccaucaugacgggcgacaucaaggggaucaugcaggccggcaagcggucccugcgcccccagcccaccgagcugaaguacagcuggaagaccuggggcaaggccaagaugcucuccaccgagagccacaaccagacguuccugaucgacgggccggagaccgccgagugccccaacaccaaccgggccuggaacucccuggaggucgaggacuacggcuucgggguguucaccacgaacaucuggcucaagcugcgcgagaagcaggacguguucugcgacagcaagcugauguccgcggccaucaaggacaaccgggccguccacgccgacaugggcuacuggaucgagagcgcccucaacgacaccuggaagauggagaaggcguccuucaucgaggucaagagcugccacuggcccaagucccacacccuguggagcaacggcgugcuggaguccgagaugaucauccccaagagcuucgccgggccggugucccagcacaacuaccgccccggcuacuacacccagaccgccgggcccuggcaccucggcaagcuggagauggacuucgacuucugcgaggggacgaccgugguggucaccgaggacugcggcaaccggggccccagccugcgcaccacgaccgccagcgggaagcucaucaccgaguggugcugccgguccugcacccugccgccccugcgcuaccggggcgaggacgggugcugguacggcauggagauccgcccccucaaggagaaggaggagaaccuggugaacagccuggugacggcggggcacggccagaucgacaacuucucccucggcguccuggggauggcccuguuccucgaggagaugcugcggacccgcgugggcaccaagcacgccauccugcucgugaccgucagcuucgugacgcugaucaccgggaacauguccuuccgggaccugggccgcgugauggucauggugggggccgccaugaccgacgacaucggcaugggcgugaccuaccucgcgcugcuggccgccuucaagguccgccccacguucgccgccgggcuccugcugcggaagcucaccagcaaggagcugaugauggcgaccaucggcaucgcccugcucucccagagcaccaucccggagacgauccuggagcugaccgacgcccucgcccuggggaugauggugcugaagaucgugcgcaacauggagaaguaccagcucgccgucaccaucauggcgaucuccugcgugcccaacgccgugauccugcagaacgccuggaaggucagcugcaccauccuggccgcgguguccgugagcccccuccugcugacguccagccagcagaaggccgacuggaucccccucgcccugaccaucaagggccugaacccgaccgccaucuuccucaccacgcugucccggaccagcaagaagcgcuccuggccccugaacgaggccaucauggcggucggcauggugagcauccucgccuccagccugcugaagaacgacauccccaugaccgggccccucgucgccggcgggcugcugaccgugugcuacgugcucacgggccggagcgccgaccuggagcuggagcgcgccaccgacgucaagugggaggaccaggcggagaucuccgggagcuccccgauccucagcaucaccaucgccgaggacggcuccaugagcaucaagaacgaggaggaggagcagacccugacgauccugauccggaccggccuccuggugaucuccgggcuguuccccgugagcauccccaucaccgccgccgccugguaccucugggaggucaagaagcagcgcgcgggcgugcugugggacgugcccuccccgccgcccgucgggaaggccgagcuggaggacggcgccuaccggaucaagcagaaggggauccucggcuacagccagaucggcgccgggguguacaaggagggcaccuuccacaccauguggcacgugacgcgcggggccguccugaugcaccggggcaagcgcaucgagccguccugggcggacgugaagaaggaccugaucagcuacgggggcggcuggaagcucgagggggaguggaaggagggcgaggaggugcagguccuggcccuggagcccgggaagaacccccgggccgugcagaccaagcccggccucuucaagaccaacaccgggacgaucggcgccgugucccuggacuucagcccgggcaccuccgggagccccaucgucgaccgcaagggcaaggugguggggcuguacggcaacggcgucgugacccgguccggggcguacgugagcgccaucgcccagaccgagaaguccaucgaggacaaccccgagaucgaggacgacaucuuccgcaagaagcggcucacgaucauggaccugcaccccggcgccgggaagaccaagcgcuaccugccggccaucguccgggaggcgaucaagcgcggccugcggacccucauccuggcccccacccgcgugguggccgccgagauggaggaggcccugcgcgggcuccccauccgguaccagacgcccgcgauccgcgccgagcacaccggccgggagaucgucgaccugaugugccacgccaccuucaccaugcgccugcucagcccggugcgggugcccaacuacaaccugaucaucauggacgaggcccacuucacggaccccgccagcaucgcggcccgcggcuacaucuccacccgggucgagaugggggaggccgccggcaucuucaugaccgcgacgccgcccgggagccgcgaccccuucccccaguccaacgcccccaucauggacgaggagcgggagauccccgagcgcagcuggaacuccggccacgagugggugacggacuucaaggggaagaccgugugguucguccccagcaucaaggccggcaacgacaucgccgccugccugcggaagaacggcaagaaggugauccagcucucccgcaagaccuucgacagcgaguacgugaagacccggacgaacgacugggacuucgucgugaccaccgacaucuccgagaugggggcgaacuucaaggccgagcgcgugaucgacccccggcgcugcaugaagcccgucauccugaccgacggcgaggagcgggugauccuggccgggccgaugcccgugacgcacagcuccgccgcccagcgccggggccgcaucgggcgcaaccccaagaacgagaacgaccaguacaucuacaugggcgagccccucgagaacgacgaggacugcgcgcacuggaaggaggccaagaugcugcuggacaacaucaacaccccggagggcaucauccccagcauguucgagcccgagcgggagaaggucgacgccaucgacggggaguaccgccuccggggcgaggcccgcaagaccuucguggaccugaugcggcgcggggaccugccgguguggcucgccuaccgggucgcggccgagggcaucaacuacgccgaccgccgguggugcuucgacggggugaagaacgaccagauccuggaggagaacguggaggucgagaucuggaccaaggagggcgagcgcaagaagcugaagccccgguggcucgacgcccgcaucuacuccgacccccuggcgcugaaggaguucaaggaguucgccgccggccgcaagagccucacgcugaaccugaucaccgagauggggcgccuccccaccuucaugacccagaaggcccgggacgcccuggacaaccuggcggugcuccacacggccgaggccggcgggcgcgccuacaaccacgcccuguccgagcugccggagacccucgagacccugcugcuccugacccugcucgcgacggugaccggcggcaucuuccuguuccugaugagcgggaagggcgucgggaagaugacccucggcaugugcugcaucaucaccgccuccauccugcugugguacgcccagauccagccccacuggaucgccgccagcaucauccucgaguucuuccugaucgugcugcucauccccgagcccgagaagcagcggaccccgcaggacaaccagcugacguacgucgugaucgcgauccugaccguggucgccgccaccauggccaacgagaugggguuccucgagaagaccaagaaggaccugggccugggcuccaucgccacgcaggagcccgagagcaacauccucgacaucgaccugcgccccgcgagcgccuggacccuguacgccguggccaccaccuucgugacgcccaugcuccggcacuccaucgagaacagcuccgucaacgugagccugaccgcgaucgccaaccaggccaccgugcugauggggcucggcaagggguggccgcuguccaagauggacaucggcgucccccugcucgccaucgggugcuacagccaggugaaccccaucacccugacggccgcgcugcuccugcugguggcccacuacgccaucaucggccccggccuccaggccaaggccacccgcgaggcgcagaagcgggccgccgccgggaucaugaagaacccgaccgucgacggcaucaccgugaucgaccuggaccccauccccuacgaccccaaguucgagaagcagcugggccaggugaugcuccugauccugugcgucacccaggugcucaugaugcgcaccaccugggcccugugcgaggcgcugacccucgccacgggcccgaucuccacccugugggaggggaaccccggccgcuucuggaacaccaccaucgccgugagcauggccaacaucuuccggggcuccuaccuggcgggggccggccuccuguucagcaucaugaagaacacgaccaacacccgccgggggaccggcaacaucggcgagacgcugggggagaaguggaagucccgccucaacgcccugggcaagagcgaguuccagaucuacaagaaguccgggauccaggaggucgaccggacccuggccaaggagggcaucaagcgcggggagaccgaccaccacgccgugagccggggcuccgcgaagcuccgcugguucguggagcggaacauggucacccccgagggcaaggugguggaccuggggugcggccgcgggggcuggagcuacuacugcgggggccugaagaacguccgggaggugaagggccucacgaagggcgggcccgggcacgaggagccgauccccauguccaccuacggcuggaaccuggugcgccugcagagcggggucgacguguucuucacgccgcccgagaagugcgacacccuccugugcgacaucggcgaguccagcccgaaccccacgaucgaggccggccggacccugcgcgugcucagccuggucgagaacuggcugaacaacgacacccaguucugcaucaaggugcucaaccccuacaugccguccgugaucgagaagauggagacccugcagcggaaguacgggggcgcccugguccgcaacccccugagccggaacuccacccacgagauguacugggugagcaacgccacggggaacaucguguccagcgucaacaugaucucccgcaugcucaucaaccgguucaccaugaagcacaagaaggccaccuacgagcccgacguggaccugggcagcgggacccgcaacaucggcaucgaguccgagauccccaaccuggacaucaucggcaagcgcaucgagaagaucaagcaggagcacgagacgagcuggcacuacgaccaggaccacccguacaagaccugggcguaccacggguccuacgagaccaagcagaccggcagcgccuccagcauggugaacggggucgugcggcuccugacgaagcccugggacgugguccccauggugacccagauggccaugaccgacaccacgcccuucggccagcagcgcguguucaaggagaaggucgacacccggacccaggagccgaaggagggcaccaagaagcugaugaagaucacggccgaguggcucuggaaggagcuggggaagaagaagacgccccggaugugcacccgggaggaguucacccgcaaggugcgguccaacgccgcgcugggcgccaucuucacggacgagaacaaguggaaguccgcccgcgaggccguggaggacucccgguucugggagcucgucgacaaggagcgcaaccugcaccuggaggggaagugcgagaccugcguguacaacaugaugggcaagcgggagaagaagcucggggaguucggcaaggcgaagggcagccgcgccaucugguacauguggcugggggcccgguuccuggaguucgaggcccucggcuuccugaacgaggaccacugguucucccgcgagaacagccugagcgggguggagggcgaggggcuccacaagcugggcuacauccugcgggacgucuccaagaaggagggcggggccauguacgcggacgacaccgccggcugggacacccgcaucacgcucgaggaccugaagaacgaggagauggugaccaaccacauggagggggagcacaagaagcuggccgaggccaucuucaagcucaccuaccagaacaaggucgugcgggugcagcgccccacgccccggggcacggucauggacaucaucagccgccgggaccagcgcggguccggccaggugggcaccuacgggcugaacaccuucaccaacauggaggcccagcugauccgccagauggagggcgaggggguguucaagagcauccagcggcucacggucaccgaggagaucgcggugcagaacuggcuggcccgcgugggccgggagcgccugucccggauggccaucagcggcgacgacugcgucgugaagccgcucgacgaccgcuucgccuccgcccugaccgcgcugaacgacauggggaaggugcggaaggacauccagcagugggagcccagccgcggcuggaacgacuggacccagguccccuucugcucccaccacuuccacgagcucaucaugaaggacgggcgggugcuggugguccccugccgcaaccaggacgagcugaucggccgggcccgcaucagccagggggccggcuggucccucaaggagacggccugccugggcaagagcuacgcccagauguggucccugauguacuuccaccggcgcgaccuccggcuggcggccaacgccaucugcagcgccgugccgucccacugggugcccaccagccgcaccaccugguccauccacgcgaagcacgaguggaugaccacggaggacaugcugaccgucuggaaccggguguggauccaggagaaccccuggauggaggacaagacccccguggagagcugggaggaggucccguaccucgggaagcgcgaggaccaguggugcggcagccugaucgggcugaccucccgggccacgugggccaagaacauccagaccgccaucaaccaggugcgcagccucaucggcaacgaggaguacaccgacuacaugcccuccaugaagcgcuuccggcgcgaggaggaggaggccggggugcugugguga

SEQ ID NO: 9664 - RNA, 9876 nt, Artificial Sequence
  derived and/or modified CDS sequence (opt1) from DENV-2__FM210224__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacacgaucaccuacaagugcccccuccugcgccagaacgagcccgaggacaucgacugcuggugcaacagcaccagcaccugggugacguacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagacguggauccugcgccaccccggcuucaccaucauggcggccauccuggccuacaccaucgggaccacgcacuuccagcgggcccucaucuucauccugcugaccgcggucgcccccagcaugaccaugcgcugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccgcaaguacugcaucgaggcgaagcugacgaacaccaccaccgagucccggugcccgacgcagggcgagcccagccugaacgaggagcaggacaagcgcuucgucugcaagcacuccaugguggaccggggcugggggaacggcugcgggcuguucggcaagggcgggaucgugaccugcgccauguucacgugcaagaagaacauggagggcaagaucguccagcccgagaaccuggaguacaccaucgugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccgcaccggccucgacuucaacgagauggugcugcugcagauggaggacaaggccuggcucgugcaccggcagugguuccuggaccugccccuccccuggcugccgggggcggacacccagggcagcaacuggauccagaaggagacgcuggucaccuucaagaacccccacgccaagaagcaggacguggugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgcggagacccagcacgggacgaucgucauccgcgugcaguacgagggcgacggcucccccugcaagauccccuucgagaucauggaccuggagaagcggcacgugcucgggcgccugaucaccgucaacccgaucgugaccgagaaggacagccccgugaacaucgaggccgagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcgcuccaccagguguucggggccaucuacggcgccgccuucagcggggucuccuggaccaugaagauccugaucggcgcgaucaucacguggaucgggaugaacagccgcuccaccagccuguccgugagccuggugcucgucggcgugaucacccuguaccugggggccauggugcaggccgacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcgcacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggccaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgagaagcaggacguguucugcgacuccaagcugaugagcgcggccaucaaggacaaccgggccgugcacgccgacaugggcuacuggaucgaguccgcccucaacgacaccuggaagauggagaaggcgagcuucaucgaggucaaguccugccacuggcccaagagccacacccugugguccaacggcgugcuggagagcgagaugaucauccccaaguccuucgccgggcccgugagccagcacaacuaccgcccgggcuacuacacccagacggccgggcccuggcaccucggcaagcuggagauggacuucgacuucugcgaggggaccaccgucguggugaccgaggacugcggcaaccggggccccagccugcgcacgaccaccgccuccgggaagcucaucaccgaguggugcugccggagcugcacgcugcccccgcugcgcuaccggggcgaggacgggugcugguacggcauggagauccgcccccucaaggagaaggaggagaaccuggucaacucccuggugaccgcggggcacggccagaucgacaacuucagccucggcgugcuggggauggcccuguuccucgaggagaugcugcggacccgcgucggcaccaagcacgccauccugcucguggccguguccuucgucacgcugaucaccgggaacaugagcuuccgggaccugggccgcgugauggugauggucggggccaccaugaccgacgacaucggcaugggcgugacguaccucgcgcugcuggccgccuucaaggugcgccccaccuucgccgccgggcuccugcugcggaagcucaccuccaaggagcugaugauggcgaccaucggcaucgcccugcucagccaguccacgauccccgagaccauccuggagcugaccgacgcccucgcccuggggaugaugguccugaagaucgugcgcaacauggagaaguaccagcucgccgugaccaucauggcgaucagcugcgucccgaacgccgugauccugcagaacgccuggaagguguccugcacgauccuggccgcggucagcgugagcccccuccugcugaccagcucccagcagaaggccgacuggaucccccucgcccugaccaucaagggccugaaccccaccgccaucuuccucacgacccugagccggaccuccaagaagcgcagcuggccgcugaacgaggccaucauggcggugggcauggucuccauccucgccagcagccugcugaagaacgacauccccaugaccgggccccucguggccggcgggcugcugacggucugcuacgugcucaccggccgguccgccgaccuggagcuggagcgcgccaccgacgugaagugggaggaccaggcggagaucagcggguccagccccauccucuccaucaccaucagcgaggacggcuccaugagcaucaagaacgaggaggaggagcagacgcugaccauccugauccggaccggccuccuggucaucuccgggcuguucccggugagcauccccaucaccgccgccgccugguaccucugggaggugaagaagcagcgcgccggcguccugugggacgugcccagcccgccgcccguggggaaggcggagcuggaggacggcgccuaccggaucaagcagaaggggauccucggcuacagccagaucggcgccggggucuacaaggagggcaccuuccacacgauguggcacgugacccgcggggccgugcugaugcaccggggcaagcgcaucgagcccuccugggccgacgucaagaaggaccugaucagcuacgggggcggcuggaagcucgagggggaguggaaggagggcgaggagguccaggugcuggcgcuggagcccgggaagaacccccgggccguccagaccaagcccggccucuucaagaccaacacggggaccaucggcgccgugucccuggacuucagccccggcaccuccgggagccccaucguggaccgcaagggcaaggucguggggcuguacggcaacggcguggucacccgguccggggccuacgugagcgcgaucgcccagacggagaaguccaucgaggacaaccccgagaucgaggacgacaucuuccgcaagaagcggcucaccaucauggaccugcaccccggcgccgggaagaccaagcgcuaccugcccgccaucgugcgggaggccaucaagcgcggccugcggacccucauccuggcgccgacgcgcgucguggccgccgagauggaggaggcccugcgcgggcuccccauccgguaccagacccccgccauccgcgcggagcacaccggccgggagaucguggaccugaugugccacgccaccuucacgaugcgccugcucucccccguccgggugccgaacuacaaccugaucaucauggacgaggcccacuucaccgaccccgccagcaucgccgcgcgcggcuacaucuccacccggguggagaugggggaggccgccggcaucuucaugaccgccacgccgcccgggagccgcgacccguucccccaguccaacgcgcccaucaucgacgaggagcgggagauccccgagcgcagcuggaacuccggccacgagugggucaccgacuucaaggggaagaccgugugguucgugccgagcaucaaggccggcaacgacaucgccgccugccugcggaagaacggcaagaaggucauccagcucucccgcaagaccuucgacagcgaguacgugaagacgcggaccaacgacugggacuucguggucaccaccgacaucuccgagaugggggccaacuucaaggcggagcgcgugaucgacccccggcgcugcaugaagcccgugauccugacggacggcgaggagcgggucauccuggccgggcccaugccggugacccacagcuccgccgcccagcgccggggccgcaucgggcgcaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgggagaagguggacgccaucgacggggaguaccgccuccggggcgaggcccgcaagaccuucgucgaccugaugcggcgcggggaccugcccguguggcucgccuaccggguggccgcggagggcaucaacuacgccgaccgccgguggugcuucgacggggccaagaacaaccagauccuggaggagaacgucgagguggagaucuggacgaaggagggcgagcgcaagaagcugaagccgcgguggcucgacgcccgcaucuacuccgacccccuggcgcugaaggaguucaaggaguucgccgccggccggaagucccucacccugaaccugaucaccgagauggggcgccuccccaccuucaugacgcagaaggcccgggacgcccuggacaaccuggcggugcuccacaccgccgaggccggcgggcgcgccuacaaccacgcccuguccgagcugcccgagacccucgagacccugcugcuccugacgcugcucgcgaccgucaccggcggcaucuuccuguuccugaugagcgggaagggcguggggaagaugacccucggcaugugcugcaucaucaccgccuccauccugcugugguacgcccagauccagccgcacuggaucgccgccagcaucauccucgaguucuuccugaucgugcugcucauccccgagcccgagaagcagcggacgccccaggacaaccagcugaccuacgucgugaucgcgauccugaccgucguggccgccaccauggccaacgagaugggguuccucgagaagacgaagaaggaccugggccugggcagcaucgccacccaggagccggaguccaacauccucgacaucgaccugcgccccgcgagcgccuggacccuguacgccguggccaccacguucgucacccccaugcuccggcacuccaucgagaacagcuccgugaacgugagccugaccgcgaucgccaaccaggccaccguccugauggggcucggcaagggguggccccuguccaagauggacaucggcgugccgcugcucgccaucgggugcuacagccaggugaaccccaucacgcugaccgccgcgcugcuccugcugaucgcccacuacgccaucaucggccccggccuccaggccaaggccacccgcgaggcgcagaagcgggccgccgccgggaucaugaagaaccccaccgucgacggcaucacggugaucgaccuggacccgauccccuacgaccccaaguucgagaagcagcugggccaggugaugcuccugauccugugcgucacccaggugcucaugaugcgcaccaccugggcccugugcgaggcgcugacgcucgccaccggccccaucuccacccugugggaggggaacccgggccgcuucuggaacaccacgaucgccgugagcauggccaacaucuuccggggcuccuaccuggcgggggccggccuccuguucagcaucaugaagaacaccaccaacacccgccgggggacgggcaacaucggcgagacccugggggagaaguggaagucccgccucaacgcccugggcaagagcgaguuccagaucuacaagaaguccgggauccaggaggucgaccggacccuggccaaggagggcaucaagcgcggggagaccgaccaccacgccgugagccggggcuccgcgaagcuccgcugguucguggagcggaacauggucacgcccgagggcaaggugguggaccuggggugcggccgcgggggcuggagcuacuacugcgggggccugaagaacguccgggaggugaagggccucaccaagggcggccccgggcacgaggagcccaucccgauguccaccuacggcuggaaccuggugcgccugcagagcggggucgacguguucuucacgccgcccgagaagugcgacacgcuccugugcgacaucggcgagagcucccccaacccgaccaucgaggccggccggacccugcgcgugcucagccuggucgagaacuggcugaacaacgacacccaguucugcaucaaggugcucaaccccuacaugcccuccgugaucgagaagauggagacccugcagcggaaguacgggggcgcccugguccgcaacccgcugagccggaacuccacgcacgagauguacugggugagcaacgccaccgggaacaucguguccagcgucaacaugaucucccgcaugcucaucaaccgguucaccaugaagcacaagaaggccaccuacgagcccgacguggaccugggcagcgggacgcgcaacaucggcaucgaguccgagauccccaaccuggacaucaucggcaagcgcaucgagaagaucaagcaggagcacgagaccagcuggcacuacgaccaggaccaccccuacaagaccugggcguaccacggguccuacgagaccaagcagacgggcagcgccuccagcauggugaacggggucgugcggcuccugaccaagccgugggacgugguccccauggugacccagauggccaugaccgacacgacccccuucggccagcagcgcguguucaaggagaaggucgacacccggacccaggagcccaaggagggcacgaagaagcugaugaagaucaccgccgaguggcucuggaaggagcuggggaagaagaagaccccgcgcaugugcacccgggaggaguucacgcgcaaggugcgguccaacgccgcgcugggcgccaucuucaccgacgagaacaaguggaaguccgcccgcgaggccguggaggacucccgguucugggagcucgucgacaaggagcgcaaccugcaccuggaggggaagugcgagaccugcguguacaacaugaugggcaagcgggagaagaagcucggggaguucggcaaggcgaagggcagccgcgccaucugguacauguggcugggggcccgguuccuggaguucgaggcccucggcuuccugaacgaggaccacugguucagccgcgagaacucccugagcgggguggagggcgaggggcuccacaagcugggcuacauccugcgggacgucuccaagaaggagggcggggccauguacgcggacgacaccgccggcugggacacgcgcaucacccucgaggaccugaagaacgaggagauggugaccaaccacauggagggggagcacaagcggcuggccgaggccaucuucaagcucaccuaccagaacaaggugguccgcgugcagcggcccacgccccgcggcaccgucauggacaucaucagccggcgcgaccagcgcggguccggccaggugggcaccuacgggcugaacaccuucacgaacauggaggcccagcugauccggcagauggagggcgaggggaucuucaagagcauccagcaccucaccgugaccgaggagaucgcgguccagaacuggcuggcccgcgugggccgggagcgccugucccggauggccaucagcggcgacgacugcguggucaagccccucgacgaccgcuucgccuccgcccugaccgcgcugaacgacauggggaaggugcggaaggacauccagcagugggagccgagcaagggcuggaacgacuggacccaggugcccuucugcucccaccacuuccacgagcucaucaugaaggacgggcgcguccugguggugcccugccggaaccaggacgagcugaucggccgcgcccggaucagccagggggccggcuggucccucaaggagaccgccugccugggcaagagcuacgcccagauguggucccugauguacuuccaccgccgggaccuccgccuggcggccaacgccaucugcagcgccguccccucccacugggugccgaccagccggaccaccuggagcauccacgcgaagcacgaguggaugacgaccgaggacaugcugaccguguggaaccgcgucuggauccaggagaaccccuggauggaggacaagacccccguggaguccugggaggaggugcccuaccucgggaagcgggaggaccaguggugcggcagccugaucgggcugacgucccgcgccaccugggccaagaacauccagaccgccaucaaccagguccggagccucaucggcaacgaggaguacaccgacuacaugccguccaugaagcgcuuccgccgggaggaggaggaggccggggugcugugguga

SEQ ID NO: 9665 - RNA, 9876 nt, Artificial Sequence
  derived and/or modified CDS sequence (opt1) from DENV-2__FM210225__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugacguacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagacguggauccugcgccaccccggcuucaccaucauggcggccauccuggccuacaccaucgggaccacgcacuuccagcgggcccucaucuucauccugcugaccgcggucgcccccagcaugaccaugcgcugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccgcaaguacugcaucgaggcgaagcugacgaacaccaccaccgagucccggugcccgacgcagggcgagcccagccugaacgaggagcaggacaagcgcuucgucugcaagcacuccaugguggaccggggcugggggaacggcugcgggcuguucggcaagggcgggaucgugaccugcgccauguucacgugcaagaagaacauggagggcaagaucguccagcccgagaaccuggaguacaccaucgugaucacgccccacagcggggaggagcacgccgugggcaacgacaccgggaagcacggcaaggagaucaagaucaccccgcaguccagcaucaccgaggccgagcugaccggguacggcacggucaccauggagugcagcccccgcaccggccucgacuucaacgagauggugcugcugcagauggaggacaaggccuggcucgugcaccggcagugguuccuggaccugccccuccccuggcugccgggggcggacacccagggcagcaacuggauccagaaggagacgcuggucaccuucaagaacccccacgccaagaagcaggacguggugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgcggagacccagcacgggacgaucgucauccgcgugcaguacgagggcgacggcucccccugcaagauccccuucgagaucauggaccuggagaagcggcacgugcucgggcgccugaucaccgucaacccgaucgugaccgagaaggacagccccgugaacaucgaggccgagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucgggggcguguucaccuccaucgggaaggcgcuccaccagguguucggcgccaucuacggcgccgccuucagcggggucuccuggaccaugaagauccugaucggcgcgaucaucacguggaucgggaugaacagccgcuccaccagccuguccgugagccuggugcucgucggcgugaucacccuguaccugggggccauggugcaggccgacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcgcacgaggagggcaucugcgggauccggagcgucacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggccaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgagaagcaggacguguucugcgacuccaagcugaugagcgcggccaucaaggacaaccgggccgugcacgccgacaugggcuacuggaucgaguccgcccucaacgacaccuggaagauggagaaggcgagcuucaucgaggucaaguccugccacuggcccaagagccacacccugugguccaacggcgugcuggagagcgagaugaucauccccaaguccuucgccgggcccgugagccagcacaacuaccgcccgggcuacuacacccagacggccgggcccuggcaccucggcaagcuggagauggacuucgacuucugcgaggggaccaccgucguggugaccgaggacugcggcaaccggggccccagccugcgcacgaccaccgccuccgggaagcucaucaccgaguggugcugccggagcugcacgcugcccccgcugcgcuaccggggcgaggacgggugcugguacggcauggagauccgcccccucaaggagaaggaggagaaccuggucaacucccuggugaccgcggggcacggccagaucgacaacuucagccucggcgugcuggggauggcccuguuccucgaggagaugcugcggacccgcgucggcaccaagcacgccauccugcucguggccguguccuucgucacgcugaucaccgggaacaugagcuuccgggaccugggccgcgugauggugauggucggggccaccaugaccgacgacaucggcaugggcgugacguaccucgcgcugcuggccgccuucaaggugcgccccaccuucgccgccgggcuccugcugcggaagcucaccuccaaggagcugaugauggcgaccaucggcaucgcccugcucagccaguccacgauccccgagaccauccuggagcugaccgacgcccucgcccuggggaugaugguccugaagaucgugcgcaacauggagaaguaccagcucgccgugaccaucauggcgaucagcugcgucccgaacgccgugauccugcagaacgccuggaagguguccugcacgauccuggccgcggucagcgugagcccccuccugcugaccagcucccagcagaaggccgacuggaucccccucgcccugaccaucaagggccugaaccccaccgccaucuuccucacgacccugagccggaccuccaagaagcgcagcuggccgcugaacgaggccaucauggcggugggcauggucuccauccucgccagcagccugcugaagaacgacauccccaugaccgggccccucguggccggcgggcugcugacggucugcuacgugcucaccggccgguccgccgaccuggagcuggagcgcgccaccgacgugaagugggaggaccaggcggagaucagcggguccagccccauccucuccaucaccaucagcgaggacggcuccaugagcaucaagaacgaggaggaggagcagacgcugaccauccugauccggaccggccuccuggucaucuccgggcuguucccggugagcauccccaucaccgccgccgccugguaccucugggaggugaagaagcagcgcgccggcguccugugggacgugcccagcccgccgcccguggggaaggcggagcuggaggacggcgccuaccggaucaagcagaaggggauccucggcuacagccagaucggcgccggggucuacaaggagggcaccuuccacacgauguggcacgugacccgcggggccgugcugaugcaccggggcaagcgcaucgagcccuccugggccgacgucaagaaggaccugaucagcuacgggggcggcuggaagcucgagggggaguggaaggagggcgaggagguccaggugcuggcgcuggagcccgggaagaacccccgggccguccagaccaagcccggccucuucaagaccaacacggggaccaucggcgccgugucccuggacuucagccccggcaccuccgggagccccaucguggaccgcaagggcaaggucguggggcuguacggcaacggcguggucacccgguccggggccuacgugagcgcgaucgcccagacggagaaguccaucgaggacaaccccgagaucgaggacgacaucuuccgcaagaagcggcucaccaucauggaccugcaccccggcgccgggaagaccaagcgcuaccugcccgccaucgugcgggaggccaucaagcgcggccugcggacccucauccuggcgccgacgcgcgucguggccgccgagauggaggaggcccugcgcgggcuccccauccgguaccagacccccgccauccgcgcggagcacaccggccgggagaucguggaccugaugugccacgccaccuucacgaugcgccugcucucccccguccgggugccgaacuacaaccugaucaucauggacgaggcccacuucaccgaccccgccagcaucgccgcgcgcggcuacaucuccacccggguggagaugggggaggccgccggcaucuucaugaccgccacgccgcccgggagccgcgacccguucccccaguccaacgcgcccaucaucgacgaggagcgggagauccccgagcgcagcuggaacuccggccacgagugggucaccgacuucaaggggaagaccgugugguucgugccgagcaucaaggccggcaacgacaucgccgccugccugcggaagaacggcaagaaggucauccagcucucccgcaagaccuucgacagcgaguacgugaagacgcggaccaacgacugggacuucguggucaccaccgacaucuccgagaugggggccaacuucaaggcggagcgcgugaucgacccccggcgcugcaugaagcccgugauccugacggacggcgaggagcgggucauccuggccgggcccaugccggugacccacagcuccgccgcccagcgccggggccgcaucgggcgcaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgggagaagguggacgccaucgacggggaguaccgccuccggggcgaggcccgcaagaccuucgucgaccugaugcggcgcggggaccugcccguguggcucgccuaccggguggccgcggagggcaucaacuacgccgaccgccgguggugcuucgacggggucaagaacaaccagauccuggaggagaacguggagguggagaucuggacgaaggagggcgagcgcaagaagcugaagccgcgguggcucgacgcccgcaucuacuccgacccccuggcccugaaggaguucaaggaguucgcggccggccggaagucccucacccugaaccugaucaccgagauggggcgccuccccaccuucaugacgcagaaggcccgggacgcccuggacaaccuggccguccuccacaccgcggaggccggcgggcgcgccuacaaccacgcccuguccgagcugcccgagacccucgagacccugcugcuccugacgcugcucgccaccgugaccggcggcaucuuccuguuccugaugagcgggaagggcguggggaagaugacccucggcaugugcugcaucaucaccgcguccauccugcugugguacgcccagauccagccgcacuggaucgccgccagcaucauccucgaguucuuccugaucguccugcucauccccgagcccgagaagcagcggacgccccaggacaaccagcugaccuacguggucaucgccauccugaccgugguggcggccaccauggccaacgagaugggguuccucgagaagacgaagaaggaccugggccugggcagcaucgccacccaggagccggaguccaacauccucgacaucgaccugcgccccgccagcgcguggacccuguacgccgucgccaccacguucgugacccccaugcuccggcacuccaucgagaacagcuccgugaacgucagccugaccgccaucgcgaaccaggccaccgugcugauggggcucggcaagggguggccccuguccaagauggacaucggcgugccgcugcucgccaucgggugcuacagccaggucaaccccaucacgcugaccgccgcccugcuccugcugaucgcgcacuacgccaucaucggccccggccuccaggccaaggccacccgcgaggcccagaagcgggcggccgccgggaucaugaagaaccccaccguggacggcaucacggugaucgaccuggacccgauccccuacgaccccaaguucgagaagcagcuggggcaggucaugcuccugauccugugcgugacccaggugcucaugaugcgcaccaccugggcccugugcgaggcccugacgcucgcgaccggccccaucuccacccugugggaggggaacccgggccgcuucuggaacaccacgaucgccgucagcauggccaacaucuuccggggcuccuaccuggccggggcgggccuccuguucagcaucaugaagaacaccaccaacacccgccgggggacgggcaacaucggcgagacccugggggagaaguggaagucccgccucaacgcccugggcaagagcgaguuccagaucuacaagaaguccgggauccaggagguggaccggacccuggccaaggagggcaucaagcgcggggagaccgaccaccacgccgugagccggggcuccgccaagcuccgcugguucgucgagcggaacauggugacgcccgagggcaagguggucgaccuggggugcggccgcgggggcuggagcuacuacugcgggggccugaagaacgugcgggaggugaagggccucaccaagggcggccccgggcacgaggagcccaucccgauguccaccuacggcuggaaccugguccgccugcagagcgggguggacguguucuucacgccgcccgagaagugcgacacgcuccugugcgacaucggcgagagcucccccaacccgaccaucgaggcgggccggacccugcgcguccucagccugguggagaacuggcugaacaacgacacccaguucugcaucaaggugcucaaccccuacaugcccuccgucaucgagaagauggagacccugcagcggaaguacgggggcgcccuggugcgcaacccgcugagccggaacuccacgcacgagauguacugggugagcaacgccaccgggaacaucgucuccagcgugaacaugaucucccgcaugcucaucaaccgguucaccaugaagcacaagaaggccaccuacgagcccgacguggaccugggcagcgggacgcgcaacaucggcaucgaguccgagauccccaaccuggacaucaucggcaagcgcaucgagaagaucaagcaggagcacgagaccagcuggcacuacgaccaggaccaccccuacaagaccugggccuaccacggguccuacgagaccaagcagacgggcagcgcguccagcauggucaacgggguggugcggcuccugaccaagccgugggacgucgugcccauggugacccagauggccaugaccgacacgacccccuucggccagcagcgcgucuucaaggagaagguggacacccggacccaggagcccaaggagggcacgaagaagcugaugaagaucaccgccgaguggcucuggaaggagcuggggaagaagaagaccccgcgcaugugcacccgggaggaguucacgcgcaaggugcgguccaacgccgcccugggcgcgaucuucaccgacgagaacaaguggaaguccgcccgcgaggccgucgaggacucccgguucugggagcucguggacaaggagcgcaaccugcaccuggaggggaagugcgagaccugcguguacaacaugaugggcaagcgggagaagaagcucggggaguucggcaaggccaagggcagccgcgcgaucugguacauguggcugggggcccgguuccuggaguucgaggcccucggcuuccugaacgaggaccacugguucagccgcgagaacucccugagcggggucgagggcgaggggcuccacaagcugggcuacauccugcgggacguguccaagaaggagggcggggccauguacgccgacgacaccgcgggcugggacacgcgcaucacccucgaggaccugaagaacgaggagauggugaccaaccacauggagggggagcacaagcggcuggccgaggccaucuucaagcucaccuaccagaacaaggucgugcgcguccagcggcccacgccccgcggcaccgugauggacaucaucagccggcgcgaccagcgcggguccggccaggugggcaccuacgggcugaacaccuucacgaacauggaggcccagcugauccggcagauggagggcgaggggaucuucaagagcauccagcaccucaccgucaccgaggagaucgccgugcagaacuggcuggcgcgcgugggccgggagcgccugucccggauggccaucagcggcgacgacugcgucgugaagccccucgacgaccgcuucgccuccgcccugaccgcccugaacgacauggggaaggugcggaaggacauccagcagugggagccgagcaagggcuggaacgacuggacgcagguccccuucugcucccaccacuuccacgagcucaucaugaaggacgggcgcgugcuggugguccccugccggaaccaggacgagcugaucggccgcgcgcggaucagccagggggccggcuggucccucaaggagaccgccugccugggcaagagcuacgcccagauguggucccugauguacuuccaccgccgggaccuccgccuggccgcgaacgccaucugcagcgccgugcccucccacugggugccgaccagccggaccaccuggagcauccacgccaagcacgaguggaugacgaccgaggacaugcugaccgucuggaaccgcguguggauccaggagaaccccuggauggaggacaagacccccguggaguccugggaggagguccccuaccucgggaagcgggaggaccaguggugcggcagccugaucgggcugacgucccgcgcgaccugggccaagaacauccagaccgccaucaaccaggugcggagccucaucggcaacgaggaguacaccgacuacaugccguccaugaagcgcuuccgccgggaggaggaggaggccggggugcugugguga

SEQ ID NO: 9666 - RNA, 9876 nt, Artificial Sequence
  derived and/or modified CDS sequence (opt1) from DENV-2__FM210226__SS-prME
accgccggcgugaucaucaugcugauccccaccgccauggcguuccaccucaccacccgcaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgacaucaaggggaucaugcaggccggcaagcggucccugcgcccccagcccaccgagcugaaguacagcuggaagaccuggggcaaggccaagaugcucuccaccgagagccacaaccagacguuccugaucgacgggccggagaccgccgagugccccaacaccaaccgggccuggaacucccuggagguggaggacuacggcuucgggguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggucaagagcugccacuggcccaagucccacacccuguggagcaacggcgugcuggaguccgagaugaucauccccaagagcuucgccgggccggugucccagcacaacuaccgccccggcuacuacacccagaccgccgggcccuggcaccucggcaagcuggagauggacuucgacuucugcgaggggacgaccguggucgugaccgaggacugcggcaaccggggccccagccugcgcaccacgaccgccagcgggaagcucaucaccgaguggugcugccgguccugcacccugccgccccugcgcuaccggggcgaggacgggugcugguacggcauggagauccgcccccucaaggagaaggaggagaaccuggugaacagccuggucacggcggggcacggccagaucgacaacuucucccucggcgugcuggggauggcccuguuccucgaggagaugcugcggacccgcgugggcaccaagcacgccauccugcucgucgccgugagcuucgugacccugaucacggggaacauguccuuccgggaccugggccgcgucauggugauggugggggccgcgaugaccgacgacaucggcaucggcgucaccuaccucgcccugcuggccgccuucaaggugcgccccaccuucgccgcggggcuccugcugcggaagcucacgagcaaggagcugaugauggccaccaucggcaucgcccugcucucccagagcaccaucccggagaccauccuggagcugacggacgcccucgcccuggggaugauggugcugaagaucguccgcaacauggagaaguaccagcucgcggugaccaucauggccaucuccugcgugcccaacgccgucauccugcagaacgccuggaaggugagcugcaccauccuggcgaccguguccgucagcccccuccugcugacguccagccagcagaaggccgacuggaucccccucgcccugaccaucaagggccugaacccgaccgccaucuuccucaccacgcugucccggaccagcaagaagcgcuccuggccccugaacgaggccaucauggcggugggcauggucagcauccucgccuccagccugcugaagaacgacauccccaugaccgggccccucguggccggcgggcugcugaccgugugcuacguccucacgggccggagcgccgaccuggagcuggagcgcgccaccgacgugaagugggaggaccaggcggagaucuccgggagcuccccgauccucagcaucaccaucgccgaggacggcuccaugagcaucaagaacgaggaggaggagcagacccugacgauccugauccggaccggccuccuggugaucuccgggcuguuccccgucagcauccccaucaccgccgccgccugguaccucugggaggugaagaagcagcgcgcgggcgugcugugggacguccccuccccgccgcccguggggaaggccgagcuggaggacggcgccuaccggaucaagcagaaggggauccucggcuacagccagaucggcgccgggguguacaaggagggcaccuuccacaccauguggcacgucacgcgcggggccgugcugaugcaccggggcaagcgcaucgagccguccugggcggacgugaagaaggaccugaucagcuacgggggcggcuggaagcucgagggggaguggaaggagggcgaggagguccaggugcuggcccuggagcccgggaagaacccccgggccgugcagaccaagcccggccucuucaagaccaacaccgggacgaucggcgccgucucccuggacuucagcccgggcaccuccgggagccccaucguggaccgcaagggcaagguggucgggcuguacggcaacggcguggugacccgguccggggcguacgucagcgccaucgcccagaccgagaaguccaucgaggacaaccccgagaucgaggacgacaucuuccgcaagaagcggcucacgaucauggaccugcaccccggcgccgggaagaccaagcgcuaccugccggccaucgugcgggaggcgaucaagcgcggccugcggacccucauccuggcccccacccgcguggucgccgccgagauggaggaggcccugcgcgggcuccccauccgguaccagacgcccgcgauccgcgccgagcacaccggccgggagaucguggaccugaugugccacgccaccuucaccaugcgccugcucagcccggugcggguccccaacuacaaccugaucaucauggacgaggcccacuucacggaccccgccagcaucgcggcccgcggcuacaucuccacccggguggagaugggggaggccgccggcaucuucaugaccgcgacgccgcccgggagccgcgaccccuucccccaguccaacgcccccaucauggacgaggagcgggagauccccgagcgcagcuggaacuccggccacgagugggugacggacuucaaggggaagaccgucugguucgugcccagcaucaaggccggcaacgacaucgccgccugccugcggaagaacggcaagaaggugauccagcucucccgcaagaccuucgacagcgaguacgucaagacccggacgaacgacugggacuucguggugaccaccgacaucuccgagaugggggcgaacuucaaggccgagcgcgucaucgacccccggcgcugcaugaagcccgugauccugaccgacggcgaggagcgggugauccuggccgggccgaugcccgucacgcacagcuccgccgcccagcgccggggccgcaucgggcgcaaccccaagaacgagaacgaccaguacaucuacaugggcgagccccucgagaacgacgaggacugcgcgcacuggaaggaggccaagaugcugcuggacaacaucaacaccccggagggcaucauccccagcauguucgagcccgagcgggagaagguggacgccaucgacggggaguaccgccuccggggcgaggcccgcaagaccuucguggaccugaugcggcgcggggaccugccggucuggcucgccuaccggguggcggccgagggcaucaacuacgccgaccgccgguggugcuucgacggggugaagaacaaccagauccuggaggagaacgucgagguggagaucuggaccaaggagggcgagcgcaagaagcugaagccccgguggcucgacgcccgcaucuacuccgacccccuggcgcugaaggaguucaaggaguucgccgccggccgcaagagccucacgcugaaccugaucaccgagauggggcgccuccccaccuucaugacccagaaggcccgggacgcccuggacaaccuggcggugcuccacacggccgaggccggcgggcgcgccuacaaccacgcccuguccgagcugccggagacccucgagacccugcugcuccugacccugcucgcgacggucaccggcggcaucuuccuguuccugaugagcgggaagggcguggggaagaugacccucggcaugugcugcaucaucaccgccuccauccugcuguggcacgcccagauccagccccacuggaucgccgccagcaucauccucgaguucuuccugaucguccugcucauccccgagcccgagaagcagcggaccccgcaggacaaccagcugacguacguggugaucgcgauccugaccgucguggccgccaccauggccaacgagaugggguuccucgagaagaccaagaaggaccugggccugggcuccaucgccacgcaggagcccgagagcaacauccucgacaucgaccugcgccccgcgagcgccuggacccuguacgccguggccaccaccuucgucacgcccaugcuccggcacuccaucgagaacagcuccgugaacgugagccugaccgcgaucgccaaccaggccaccguccugauggggcucggcaagggguggccgcuguccaagauggacaucggcgugccccugcucgccaucgggugcuacagccaggugaaccccaucacccugacggccgcgcugcuccugcuggucgcccacuacgccaucaucggccccggccuccaggccaaggccacccgcgaggcgcagaagcgggccgccgccgggaucaugaagaacccgaccguggacggcaucaccgugaucgaccuggaccccauccccuacgaccccaaguucgagaagcagcuggggcaggucaugcuccugauccugugcgugacccaggugcucaugaugcgcaccaccugggcccugugcgaggcgcugacccucgccacgggcccgaucuccacccugugggaggggaaccccggccgcuucuggaacaccaccaucgccgucagcauggccaacaucuuccggggcuccuaccuggcgggggccggccuccuguucagcaucaugaagaacacgaccaacacccgccgggggaccggcaacaucggcgagacgcugggggagaaguggaagucccgccucaacgcccugggcaagagcgaguuccagaucuacaagaaguccgggauccaggagguggaccggacccuggccaaggagggcaucaagcgcggggagaccgaccaccacgccgugagccggggcuccgcgaagcuccgcugguucgucgagcggaacauggugacccccgagggcaagguggucgaccuggggugcggccgcgggggcuggagcuacuacugcgggggccugaagaacgugcgggaggugaagggccucacgaagggcggccccgggcacgaggagccgguccccauguccaccuacggcuggaaccuggugcgccugcagagcgggguggacgucuucuucacgccgcccgagaagugcgacacccuccugugcgacaucggcgaguccagcccgaaccccacgaucgaggccggccggacccugcgcgugcucagccugguggagaacuggcugaacaacgacacccaguucugcaucaagguccucaaccccuacaugccguccgugaucgagaagauggagacccugcagcggaaguacgggggcgcccuggugcgcaacccccugagccggaacuccacccacgagauguacugggucagcaacgccacggggaacaucguguccagcgugaacaugaucucccgcaugcucaucaaccgguucaccaugaagcacaagaaggccaccuacgagcccgacgucgaccugggcagcgggacccgcaacaucggcaucgaguccgagauccccaaccuggacaucaucggcaagcgcaucgagaagaucaagcaggagcacgagacgagcuggcacuacgaccaggaccacccguacaagaccugggcguaccacggguccuacgagaccaagcagaccggcagcgccuccagcauggugaacggggugguccggcuccugacgaagcccugggacguggugcccauggucacccagauggccaugaccgacaccacgcccuucggccagcagcgcguguucaaggagaagguggacacccggacccaggagccgaaggagggcaccaagaagcugaugaagaucacggccgaguggcucuggaaggagcuggggaagaagaagacgccccggaugugcacccgggaggaguucacccgcaagguccgguccaacgccgcgcugggcgccaucuucacggacgagaacaaguggaaguccgcccgcgaggccguggaggacucccgguucugggagcucguggacaaggagcgcaaccugcaccuggaggggaagugcgagaccugcgucuacaacaugaugggcaagcgggagaagaagcucggggaguucggcaaggcgaagggcagccgcgccaucugguacauguggcugggggcccgguuccuggaguucgaggcccucggcuuccugaacgaggaccacugguucucccgcgagaacagccugagcgggguggagggcgaggggcuccacaagcugggcuacauccugcgggacgucuccaagaaggagggcggggccauguacgcggacgacaccgccggcugggacacccgcaucacgcucgaggaccugaagaacgaggagauggugaccaaccacauggagggggagcacaagaagcuggccgaggccaucuucaagcucaccuaccagaacaaggugguccgggugcagcgccccacgccccggggcacggugauggacaucaucagccgccgggaccagcgcggguccggccaggucggcaccuacgggcugaacaccuucaccaacauggaggcccagcugauccgccagauggagggcgaggggaucuucaagagcauccagcaccucacggugaccgaggagaucgcggugcagaacuggcuggcccgggucggccgcgagcggcugucccgcauggccaucagcggcgacgacugcguggugaagccgcucgacgaccgguucgccuccgcccugaccgcgcugaacgacauggggaagguccgcaaggacauccagcagugggagcccagccggggcuggaacgacuggacccaggugcccuucugcucccaccacuuccacgagcucaucaugaaggacgggcgcgugcuggucgugcccugccggaaccaggacgagcugaucggccgcgcccggaucagccagggggccggcuggucccucaaggagacggccugccugggcaagagcuacgcccagauguggucccugauguacuuccaccgccgggaccuccgccuggcggccaacgccaucugcagcgccgugccgucccacuggguccccaccagccggaccaccugguccauccacgcgaagcacgaguggaugaccacggaggacaugcugaccguguggaaccgcguguggauccaggagaaccccuggauggaggacaagacccccgucgagagcugggaggaggugccguaccucgggaagcgggaggaccaguggugcggcagccugaucgggcugaccucccgcgccacgugggccaagaacauccagaccgccaucaaccaggugcggagccucaucggcaacgaggaguacaccgacuacaugcccuccaugaagcgcuuccgccgggaggaggaggaggccgggguccugugguga

SEQ ID NO: 9667 - RNA, 9876 nt, Artificial Sequence
  derived and/or modified CDS sequence (opt1) from DENV-2__FM210227__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagaccuggauccugcgccaccccggcuucaccaucauggcggccauccuggccuacaccaucgggaccacgcacuuccagcgggcccucaucuucauccugcugaccgcggucgcccccagcaugaccaugcgcugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccgcaaguacugcaucgaggcgaagcugacgaacaccaccaccgagucccggugcccgacgcagggcgagcccagccugaacgaggagcaggacaagcgcuucgucugcaagcacuccaugguggaccggggcugggggaacggcugcgggcuguucggcaagggcgggaucgugaccugcgccauguucacgugcaagaagaacauggagggcaagaucguccagcccgagaaccuggaguacaccaucgugaucacgccccacagcggggaggagcacgccgugggcaacgacaccgggaagcacggcaaggagaucaagaucaccccgcaguccagcgucaccgaggccgagcugaccggguacggcacggugaccauggagugcagcccccgcaccggccucgacuucaacgagauggugcugcugcagauggaggacaaggccuggcucguccaccggcagugguuccuggaccugccccuccccuggcugccgggggcggacacccagggcagcaacuggauccagaaggagacgcuggugaccuucaagaacccccacgccaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgcggagacccagcacgggacgaucgugauccgcgugcaguacgagggcgacggcucccccugcaagauccccuucgagaucauggaccuggagaagcggcacguccucgggcgccugaucaccgugaacccgaucgugaccgagaaggacagccccgucaacaucgaggccgagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcgcuccaccaggucuucggggccaucuacggcgccgccuucagcgggguguccuggaccaugaagauccugaucggcgcgaucaucacguggaucgggaugaacagccgcuccaccagccuguccgugagccugguccucgugggcgugaucacccuguaccugggggccaugguccaggccgacuccggcugcguggugagcuggaagaacaaggagcucaagugcggcuccgggaucuucaucaccgacaacguccacacguggaccgagcaguacaaguuccagcccgagagccccagcaagcuggccuccgccauccagaaggcgcacgaggagggcaucugcgggauccggagcgugacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggccaagaugcucagcacggagucccacaaccagaccuuccugaucgacgggcccgagaccgccgagugcccgaacaccaaccgggccuggaacagccuggaggucgaggacuacggcuucgggguguucacgaccaacaucuggcucaagcugcgcgagaagcaggacguguucugcgacuccaagcugaugagcgcggccaucaaggacaaccgggccguccacgccgacaugggcuacuggaucgaguccacccucaacgacaccuggaagauggagaaggccagcuucaucgaggugaaguccugccacuggcccaagagccacacccugugguccaacggcgugcuggagagcgagaugaucauccccaaguccuucgcggggcccgucagccagcacaacuaccgcccgggcuaccacacgcagaccgccgggcccuggcaccucggcaagcuggagauggacuucgacuucugcgaggggaccaccgugguggucacggaggacugcggcaaccggggccccagccugcgcaccaccaccgccuccgggaagcucaucacggaguggugcugccggagcugcacccugcccccgcugcgcuaccggggcgaggacgggugcugguacggcauggagauccgcccccucaaggagaaggaggagaaccuggugaacucccuggugaccgccgggcacggccagaucgacaacuucagccucggcguccuggggauggcgcuguuccucgaggagaugcugcggacccgcgugggcacgaagcacgccauccugcucguggccgucuccuucgugacccugaucaccgggaacaugagcuuccgggaccugggccgcgugauggucauggugggggccaccaugacggacgacaucggcaugggcgugaccuaccucgcccugcuggcggccuucaagguccgccccaccuucgccgccgggcuccugcugcggaagcucaccuccaaggagcugaugauggccacgaucggcaucgcgcugcucagccaguccaccauccccgagaccauccuggagcugaccgacgcccucgcccuggggaugaugauccugaagaucgugcgcaacauggagaaguaccagcucgccgugacgaucauggccaucagcugcgucccgaacgcggugauccugcagaacgccuggaagguguccugcaccauccuggccgccgucagcgugagcccccuccugcugaccagcucccagcagaaggcggacuggaucccccucgcccugaccaucaagggccugaaccccacggccaucuuccucaccacccugagccggaccuccaagaagcgcagcuggccgcugaacgaggccaucauggccgugggcauggucuccauccucgcgagcagccugcugaagaacgacauccccaugacggggccccucguggccggcgggcugcugaccgucugcuacgugcucaccggccgguccgccgaccuggagcuggagcgcgccaccgacgugaagugggaggaccaggccgagaucagcggguccagccccauccucuccaucacgaucagcgaggacggcuccaugagcaucaagaacgaggaggaggagcagacccugaccauccugauccggaccggccuccuggucaucuccgggcuguucccggugagcauccccaucaccgcggccgccugguaccucugggaggugaagaagcagcgcgccggcguccugugggacgugcccagcccgccgcccguggggaaggccgagcuggaggacggcgcguaccggaucaagcagaaggggauccucggcuacagccagaucggcgccggggucuacaaggagggcacguuccacaccauguggcacgugacccgcggggccgugcugaugcaccggggcaagcgcaucgagcccuccugggccgacgucaagaaggaccugaucagcuacgggggcggcuggaagcucgagggggaguggaaggagggcgaggagguccaggugcuggcccuggagcccgggaagaacccccgggcgguccagaccaagcccggccucuucaagacgaacaccgggaccaucggcgccgugucccuggacuucagccccggcaccuccgggagccccaucguggaccgcaagggcaaggucguggggcuguacggcaacggcguggucacgcgguccggggccuacgugagcgccaucgcgcagaccgagaaguccaucgaggacaaccccgagaucgaggacgacaucuuccgcaagaagcggcucaccaucauggaccugcaccccggcgccgggaagaccaagcgcuaccugcccgccaucgugcgggaggccaucaagcgcggccugcggacgcucauccuggccccgacccgcgucguggcggccgagauggaggaggcccugcgcgggcuccccauccgguaccagacccccgccauccgcgccgagcacaccggccgggagaucguggaccugaugugccacgcgacguucaccaugcgccugcucucccccguccgggugccgaacuacaaccugaucaucauggacgaggcccacuucaccgaccccgccagcaucgccgcccgcggcuacaucuccacccggguggagaugggggaggcggccggcaucuucaugacggccacgccgcccgggagccgcgacccguucccccaguccaacgcccccaucauggacgaggagcgggagauccccgagcgcagcuggaacuucggccacgagugggucaccgacuucaaggggaagaccgugugguucgugccguccaucaaggcgggcaacgacaucgccgccugccugcggaagaacggcaagaaggucauccagcucagccgcaagacguucgacuccgaguacgugaagacccggaccaacgacugggacuucguggucaccacggacaucagcgagaugggggccaacuucaaggccgagcgcgugaucgacccccggcgcugcaugaagcccgugauccugaccgacggcgaggagcgggucauccuggcggggcccaugccggugacccacuccagcgccgcccagcgccggggccgcaucgggcgcaaccccaagaacgagaacgaccaguacaucuacaugggcgagccccucgagaacgacgaggacugcgcccacuggaaggaggccaagaugcugcuggacaacaucaacacccccgagggcaucaucccguccauguucgagcccgagcgggagaagguggacgcgaucgacggggaguaccgccuccggggcgaggcccgcaagacguucgucgaccugaugcggcgcggggaccugcccguguggcucgccuaccggguggccgccgagggcaucaacuacgcggaccgccgguggugcuucgacggggucaagaacaaccagauccuggaggagaacguggagguggagaucuggaccaaggagggcgagcgcaagaagcugaagccgcgguggcucgacgcccgcaucuacagcgacccccuggcccugaaggaguucaaggaguucgccgcgggccggaagucccucacccugaaccugaucaccgagauggggcgccuccccacguucaugacccagaaggcccgggacgcccuggacaaccuggccguccuccacaccgccgaggcgggcgggcgcgccuacaaccacgcccugagcgagcugcccgagacccucgagacgcugcugcuccugacccugcucgccaccgugaccggcggcaucuuccuguuccugauguccgggaagggcguggggaagaugacccucggcaugugcugcaucaucacggccagcauccugcugugguacgcgcagauccagccgcacuggaucgccgccuccaucauccucgaguucuuccugaucguccugcucauccccgagcccgagaagcagcggacgccccaggacaaccagcugaccuacguggucaucgccauccugaccgugguggccgcgacgauggccaacgagaugggguuccucgagaagaccaagaaggaccugggccugggcagcgucgccacccaggagccggagagcaacauccucgacaucgaccugcgccccgccuccgccuggacccuguacgcgguggccacgaccuucgugacccccaugcuccggcacagcaucgagaacuccagcgucaacgugucccugaccgccaucgccaaccaggcgacggugcugauggggcucggcaagggguggccccugagcaagauggacaucggcgucccgcugcucgccaucgggugcuacucccaggugaaccccaucacccugaccgccgcccugcuccugcugguggcccacuacgcgaucaucggccccggccuccaggccaaggccacccgcgaggcccagaagcgggccgcggccgggaucaugaagaaccccacggucgacggcaucaccgugaucgaccuggacccgauccccuacgaccccaaguucgagaagcagcugggccaggugaugcuccugauccugugcgucacccaggugcucaugaugcgcaccacgugggcccugugcgaggcccugacccucgccaccggccccaucagcacccugugggaggggaacccgggccgcuucuggaacacgaccaucgcgguguccauggccaacaucuuccggggcagcuaccuggccggggccggccuccuguucuccaucaugaagaacaccaccaacacgcgccgggggaccggcaacaucggcgagacccugggggagaaguggaagucccgccucaacgcgcugggcaaguccgaguuccagaucuacaagaaguccgggauccaggaggucgaccggacccuggccaaggagggcaucaagcgcggggagacggaccaccacgccgugucccggggcagcgccaagcuccgcugguucguggagcggaacauggucacccccgagggcaaggugguggaccuggggugcggccgcgggggcugguccuacuacugcgggggccugaagaacguccgggaggugaagggccucaccaagggcgggcccgggcacgaggagcccaucccgaugagcaccuacggcuggaaccuggugcgccugcaguccggggucgacguguucuucacgccgcccgagaagugcgacacccuccugugcgacaucggcgagagcagccccaacccgaccaucgaggccggccggacccugcgcgugcucucccuggucgagaacuggcugaacaacgacacccaguucugcaucaaggugcucaaccccuacaugcccagcgugaucgagaagauggagacgcugcagcggaaguacgggggcgcgcugguccgcaacccgcugucccggaacagcacccacgagauguacuggguguccaacgccaccgggaacaucgugagcuccgucaacaugaucagccgcaugcucaucaaccgguucaccaugaagcacaagaaggccacguacgagcccgacguggaccugggcuccgggacccgcaacaucggcaucgagagcgagauccccaaccuggacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggugaacggggucgugcggcuccugaccaagccgugggacgugguccccauggugacccagauggcgaugacggacaccacccccuucggccagcagcgcguguucaaggagaaggucgacacccggacgcaggagcccaaggagggcaccaagaagcugaugaagaucaccgccgaguggcucuggaaggagcuggggaagaagaagaccccgcgcaugugcacgcgggaggaguucacccgcaaggugcggagcaacgccgcccugggcgccaucuucaccgacgagaacaaguggaaguccgcgcgcgaggccguggaggacagccgguucugggagcucgucgacaaggagcgcaaccugcaccuggaggggaagugcgagaccugcguguacaacaugaugggcaagcgggagaagaagcucggggaguucggcaaggccaagggcucccgcgccaucugguacauguggcugggggcgcgguuccuggaguucgaggcccucggcuuccugaacgaggaccacugguucagccgcgagaacagccuguccgggguggagggcgaggggcuccacaagcugggcuacauccugcgggacgucagcaagaaggagggcggggccauguacgccgacgacacggccggcugggacacccgcaucacccucgaggaccugaagaacgaggagauggugaccaaccacaugggcggcgagcacaagcggcuggcggaggccaucuucaagcucacguaccagaacaaggucgugcgcgugcagcggcccacgccccgcgggaccgucauggacaucaucucccggcgcgaccagcgcggcagcggccagguggggaccuacggccugaacacguucaccaacauggaggcccagcugauccggcagauggagggggagggcaucuucaaguccauccagcaccucaccgugaccgaggagaucgccguccagaacuggcuggcccgcgugggccgggagcgccugagccggauggcgaucuccggggacgacugcguggucaagccccucgacgaccgcuucgccagcgcccugacggcccugaacgacaugggcaaggugcggaaggacauccagcagugggagccguccaagggguggaacgacuggacccaggugcccuucugcagccaccacuuccacgaccucaucaugaaggacggccgcguccugguggugcccugccggaaccaggacgagcugaucgggcgcgcccggaucucccagggcgcgggcuggagccucaaggagaccgccugccuggggaaguccuacgcccagauguggagccugauguacuuccaccgccgggaccuccgccuggccgccaacgcgaucugcuccgccguccccagccacugggugccgaccucccggaccacguggagcauccacgccaagcacgaguggaugaccaccgaggacaugcugaccguguggaaccgcgucuggauccaggagaaccccuggauggaggacaagacgcccguggagagcugggaggaggugcccuaccucggcaagcgggaggaccaguggugcgggucccugaucggccugaccagccgcgccaccugggcgaagaacauccagaccgccaucaaccagguccggucccucaucgggaacgaggaguacacggacuacaugccgagcaugaagcgcuuccgccgggaggaggaggaggccggcgugcugugguga

SEQ ID NO: 9668 - RNA, 9876 nt, Artificial Sequence
  derived and/or modified CDS sequence (opt1) from DENV-2__FM210204__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacacgaucaccuacaagugcccccuccugcggcagaacgagcccgaggacaucgacugcuggugcaacuccaccuccaccugggugacguacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagacguggauccugcggcaccccggcuucaccaucauggcggccauccuggccuacaccaucgggaccacgcacuuccagcgggcccucaucuucauccugcugaccgcggucgcccccagcaugaccaugcgcugcaucggcaucuccaaccgggacuucguggagggcgugagcgggggcuccugggucgacaucgugcucgagcacgggagcugcgugaccacgauggccaagaacaagcccacccuggacuucgagcugaucaagaccgaggccaagcagcccgccacccuccgcaaguacugcaucgaggcgaagcugacgaacaccaccaccgagucccggugccccacgcagggcgagcccagccugaacgaggagcaggacaagcgcuucgucugcaagcacuccaugguggaccggggcugggggaacggcugcgggcuguucggcaagggcgggaucgugaccugcgccauguucacgugcaagaagaacauggagggcaagaucguccagcccgagaaccuggaguacaccaucgugaucacgccccacagcggggaggagcacgccgugggcaacgacaccgggaagcacggcaaggagaucaagaucacgccccaguccagcgucaccgaggccgagcugaccggguacggcaccgugaccauggagugcagcccccggaccggccucgacuucaacgagauggugcugcugcagauggaggacaaggccuggcucguccaccggcagugguuccuggaccugccccuccccuggcugccgggggcggacacccagggcagcaacuggauccagaaggagacgcuggugaccuucaagaacccccacgccaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgcggagacccagcacgggacgaucgugauccgcgugcaguacgagggcgacggcucccccugcaagauccccuucgagaucauggaccuggagaagcggcacguccucgggcgccugaucaccgugaacccgaucgugaccgagaaggacagccccgucaacaucgaggccgagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcgcuccaccaggucuucggggccaucuacggcgccgccuucagcgggguguccuggaccaugaagauccugaucggcgcgaucaucacguggaucgggaugaacagccgcuccaccagccuguccgugagccugguccucgugggcgugaucacccuguaccugggggccaugguccaggccgacuccggcugcguggugagcuggaagaacaaggagcucaagugcggcuccgggaucuucaucaccgacaacguccacacguggaccgagcaguacaaguuccagcccgagagccccagcaagcuggccuccgccauccagaaggcguacgaggagggcaucugcgggauccggagcgugacccgccuggagaaccucauguggaagcagaucacccccgagcugaaccacauccuguccgagaacgaggugaagcucacgaucaugaccggcgacaucaaggggaucaugcaggccggcaagcggagccugcgcccgcagcccaccgagcugaaguacuccuggaagaccuggggcaaggccaagaugcucagcacggagucccacaaccagaccuuccugaucgacgggcuggagaccgccgagugccccaacaccaaccgggccuggaacagccucgaggucgaggacuacggcuucgggguguucacgaccaacaucuggcugaagcugcgcgagaagcaggacguguucugcgacuccaagcucaugagcgcggccaucaaggacaaccgggccguccacgccgacaugggcuacuggaucgaguccgcccugaacgacaccuggaagauggagaaggcgagcuucaucgaggugaaguccugccacuggcccaagagccacacccugugguccaacggcgugcucgagagcgagaugaucauccccaaguccuucgccgggcccgucagccagcacaacuaccgccccggcuaccacacccagacggccgggccguggcaccugggcaagcuggagauggacuucgacuucugcgaggggaccaccgugguggucaccgaggacugcggcaaccggggccccagccuccgcacgaccaccgccuccgggaagcugaucaccgaguggugcugccggagcugcacgcugccgccccuccgcuaccggggcgaggacgggugcugguacggcauggagauccgcccgcugaaggagaaggaggagaaccuggugaacucccucgugaccgcggggcacggccagaucgacaacuucagccugggcguccuggggauggcccucuuccuggaggagaugcugcggacccgcgugggcaccaagcacgccauccuccugguggccgucuccuucgugacgcugaucaccgggaacaugagcuucaaggaccucggccgggugauggucauggugggggccaccaugaccgacgacaucggcaugggcgugacguaccuggcgcugcucgccgccuucaagguccgccccaccuucgccgccgggcugcugcuccgcaagcugaccuccaaggagcugaugauggcgaccaucggcaucgcccuccugagccaguccacgauccccgagaccauccuggagcucaccgacgcccuggcccuggggaugauggugcucaagaucgugcggaacauggagaaguaccagcuggccgucaccaucauggcgaucagcugcgugcccaacgccgugauccugcagaacgccuggaaggucuccugcacgauccucgccgcggugagcguguccccgcugcugcucaccagcucccagcagaaggccgacuggaucccccuggcccugaccaucaagggccucaaccccaccgccaucuuccugacgacccugagccgcaccuccaagaagcggagcuggccccucaacgaggccaucauggcggucggcaugguguccauccuggccagcagccugcucaagaacgacaucccgaugaccgggccccuggucgccggcgggcugcucacggugugcuacgugcugaccggccgcuccgccgaccuggagcucgagcgggccaccgacgucaagugggaggaccaggcggagaucagcggguccagccccauccuguccaucaccaucagcgaggacggcuccaugagcaucaagaacgaggaggaggagcagacgcugaccauccucauccgcaccggccugcuggugaucuccggccucuuccccgugagcaucccgaucaccgccgccgccugguaccugugggaggucaagaagcagcgggccggcgugcugugggacgugcccagcccgccgcccgucgggaaggcggagcucgaggacggcgccuaccgcaucaagcagaaggggauccugggcuacagccagaucggcgccgggguguacaaggagggcaccuuccacacgauguggcacgugacccgcggggccguccugaugcaccgcggcaagcggaucgagcccuccugggccgacgugaagaaggaccucaucagcuacgggggcggcuggaagcuggagggggaguggaaggagggcgaggaggugcagguccuggcgcucgagcccgggaagaacccgcgcgccgugcagaccaagcccggccuguucaagaccaacacggggaccaucggcgccgugucccuggacuucagccccggcaccuccgggagccccaucgucgaccggaagggcaaggugguggggcucuacggcaacggcgucgugacccgcuccggggccuacgugagcgcgaucgcccagacggagaaguccaucgaggacaacccggagaucgaggacgacaucuuccggaagaagcgccugaccaucauggaccugcaccccggcgccgggaagaccaagcgguaccugcccgccaucguccgcgaggccaucaagcggggccuccgcacccugauccuggcgcccacgcgggugguggccgccgagauggaggaggcccuccgcgggcugccgauccgcuaccagacccccgccauccgggcggagcacaccggccgcgagaucgucgaccugaugugccacgccaccuucacgaugcggcuccugagccccgugcgcgugcccaacuacaaccugaucaucauggacgaggcccacuucaccgacccggccagcaucgccgcgcggggcuacaucuccacccgcgucgagaugggggaggccgccggcaucuucaugaccgccacgccgcccgggagccgggaccccuucccgcaguccaacgcgcccaucauggacgaggagcgcgagauccccgagcggagcuggaacuccggccacgagugggugaccgacuucaaggggaagaccgugugguucguccccagcaucaaggccggcaacgacaucgccgccugccuccgcaagaacggcaagaaggugauccagcugucccggaagaccuucgacagcgaguacgugaagacgcgcaccaacgacugggacuucgucgugaccaccgacaucuccgagaugggggccaacuucaaggcggagcgggugaucgacccgcgccggugcaugaagcccgucauccugacggacggcgaggagcgcgugauccucgccgggcccaugcccgugacccacagcuccgccgcccagcggcgcggccggaucgggcgcaacccgaagaacgagaacgaccaguacaucuacaugggcgagccccuggagaacgacgaggacugcgcccacuggaaggaggcgaagaugcugcucgacaacaucaacacccccgagggcaucauccccagcauguucgagccggagcgcgagaaggucgacgccaucgacggggaguaccggcugcgcggcgaggcccggaagaccuucguggaccugaugcgccgcggggaccuccccguguggcuggccuaccgcgucgccgcggagggcaucaacuacgccgaccggcgcuggugcuucgacggggugaagaacaaccagauccuggaggagaacguggaggucgagaucuggacgaaggagggcgagcggaagaagcucaagccccgcuggcuggacgcccggaucuacuccgacccgcuggcccucaaggaguucaaggaguucgcggccggccgcaagagccugacccugaaccucaucaccgagauggggcggcugcccaccuucaugacgcagaaggcccgcgacgcccuggacaaccucgccgugcugcacaccgcggaggccggcgggcgggccuacaaccacgcccuguccgagcuccccgagacccuggagacccugcuccugcugacgcuccuggccaccgugaccggcggcaucuuccuguuccucaugagcgggaagggcgucgggaagaugacccugggcaugugcugcaucaucaccgcguccauccugcucugguacgcccagauccagccccacuggaucgccgccagcaucauccuggaguucuuccugaucgugcuccugaucccggagcccgagaagcagcgcacgccccaggacaaccagcugaccuacgucgugaucgccauccucaccguggucgcggccaccauggccaacgagaugggguuccuggagaagacgaagaaggaccugggccucggcagcguggccacccaggagcccgaguccaacauccuggacaucgaccugcggccggccagcgcguggacccucuacgccguggccaccacguucgucacccccaugcugcgccacuccaucgagaacagcuccgugaacgugagccugaccgccaucgcgaaccaggccaccguccucauggggcugggcaagggguggccccuguccaagauggacaucggcgugccccuccuggccaucgggugcuacagccaggugaacccgaucacgcugaccgccgcccuccugcugcucgucgcgcacuacgccaucaucggccccggccugcaggccaaggccacccgggaggcccagaagcgcgcggccgccgggaucaugaagaaccccaccguggacggcaucacggugaucgaccuggaccccaucccguacgaccccaaguucgagaagcagcucgggcaggucaugcugcugauccucugcgugacccaggugcugaugaugcggaccaccugggcccugugcgaggcccucacgcuggcgaccggccccaucuccacccugugggaggggaaccccggccgcuucuggaacaccacgaucgccgucagcauggccaacaucuuccgcggcuccuaccucgccggggcgggccugcuguucagcaucaugaagaacaccaccaacacccggcgcgggacgggcaacaucggcgagacccucggggagaaguggaagucccggcugaacgcccugggcaagagcgaguuccagaucuacaagaaguccgggauccaggagguggaccgcacccucgccaaggagggcaucaagcgcggggagaccgaccaccacgccgugagccgcggcuccgccaagcugcggugguucgucgagcgcaacauggugacgccggagggcaagguggucgaccuggggugcggccgcgggggcuggagcuacuacugcgggggccucaagaacgugcgcgaggugaagggccugaccaagggcggccccgggcacgaggagcccauccccauguccaccuacggcuggaaccugguccggcuccagagcgggguggacguguucuucaccccgcccgagaagugcgacacgcugcugugcgacaucggcgagagcucccccaaccccaccaucgaggcgggccgcacccuccggguccugagccugguggagaacuggcucaacaacgacacccaguucugcaucaaggugcugaacccguacaugccgcccgucaucgagaagauggagacccugcagcgcaaguacgggggcgcccuggugcggaacccgcucucccgcaacagcacgcacgagauguacuggguguccaacgccaccgggaacaucgucagcuccgugaacaugaucagccggaugcugaucaaccgcuucaccaugaagcacaagaaggccaccuacgagcccgacguggaccugggcuccgggacgcggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagaccaagcagacgggcuccgcgagcuccauggucaacgggguggugcgccugcugaccaagccgugggacgucgugcccauggugacccagauggccaugaccgacacgacccccuucggccagcagcgggucuucaaggagaagguggacacccgcacccaggagcccaaggagggcacgaagaagcucaugaagaucaccgccgaguggcuguggaaggagcuggggaagaagaagaccccgcggaugugcacccgcgaggaguucacgcggaaggugcgcagcaacgccgcccucggcgcgaucuucaccgacgagaacaaguggaaguccgcccgggaggccgucgaggacagccgcuucugggagcugguggacaaggagcggaaccugcaccucgaggggaagugcgagaccugcguguacaacaugaugggcaagcgcgagaagaagcugggggaguucggcaaggccaagggcucccgggcgaucugguacauguggcugggggcccgcuuccucgaguucgaggcccugggcuuccugaacgaggaccacugguucagccgggagaacagccucuccggggucgagggcgaggggcugcacaagcugggcuacauccuccgcgacgugagcaagaaggagggcggggccauguacgccgacgacaccgcgggcugggacacgcggaucacccuggaggaccugaagaacgaggagauggucaccaaccacauggagggggagcacaagcgccucgccgaggccaucuucaagcugaccuaccagaacaagguggugcggguccagcgccccacgccccggggcaccgugauggacaucaucucccgccgggaccagcgcgggagcggccaggugggcaccuacgggcugaacaccuucacgaacauggaggcccagcucauccgccagauggagggcgaggggaucuucaaguccauccagcaccugaccgucaccgaggagaucgccgugcagaacuggcuggcgcgggugggccgcgagcggcucagccgcauggccaucuccggcgacgacugcgucgugaagccccuggacgaccgguucgccagcgcccugaccgcccucaacgacauggggaaggugcgcaaggacauccagcagugggagccguccaagggcuggaacgacuggacgcagguccccuucugcagccaccacuuccacgaccugaucaugaaggacgggcgggugcuggugguccccugccgcaaccaggacgagcucaucggccgggcgcgcaucucccagggggccggcuggagccugaaggagaccgccugccugggcaaguccuacgcccagauguggagccucauguacuuccaccggcgcgaccugcggcuggccgcgaacgccaucugcuccgccgugcccagccacugggugccgaccucccgcaccaccuggagcauccacgccaagcacgaguggaugacgaccgaggacaugcucaccgucuggaaccggguguggauccaggagaaccccuggauggaggacaagacccccguggagagcugggaggagguccccuaccuggggaagcgcgaggaccaguggugcggcucccugaucgggcucacgagccgggcgaccugggccaagaacauccagaccgccaucaaccaggugcgcucccugaucggcaacgaggaguacaccgacuacaugccgagcaugaagcgguuccgccgcgaggaggaggaggccggggugcugugguga

SEQ ID NO: 9669 - RNA, 9876 nt, Artificial Sequence
  derived and/or modified CDS sequence (opt1) from DENV-2__FM210230__SS-prME
accgccggggugaucaucaugcugauccccaccgccauggcguuccaccucaccacccgcaacggggagccccacaugaucgucggccggcaggagaagggcaagagccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacgcccagcggaucgagaccuggauccugcgccacccgggcuucaccaucauggcggccauccuggccuacaccgucgggaccacccacuuccagcgggcccucaucuucauccugcuggcggccguggcccccagcaugaccaugcgcugcaucggcaucuccaaccgggacuucguggagggcgucagcgggggcuccuggguggacaucgugcucgagcacgggagcugcgucaccaccauggccaagaacaagcccacccuggacuucgagcugaucaagaccgaggccaagcagcccgcgacccuccgcaaguacugcaucgaggccaagcugaccaacacgaccaccgagucccggugcccgacccagggcgagcccagccugaacgaggagcaggacaagcgcuucgugugcaagcacuccaugguggaccggggcugggggaacggcugcgggcuguucggcaagggcgggaucgucacgugcgccauguucacgugcaagaagaacauggagggcaagaucgugcagcccgagaaccuggaguacaccaucgugaucacgccccacagcggggaggagcacgccgucggcaacgacacggggaagcacggcaaggagaucaagaucaccccgcagucccccaucaccgaggccgagcugaccggguacggcaccgugacgauggagugcagcccccgcaccggccucgacuucaacgagauggugcugcugcagauggaggacaaggcguggcucguccaccggcagugguuccuggaccugccccucccguggcugcccggggccgacacccagggcuccaacuggauccagaaggagacccuggugacguucaagaacccccacgccaagaagcaggacguggucgugcucgggagccaggagggcgccaugcacaccgcccugaccggggcgaccgagauccagauguccagcggcaaccuccuguucacgggccaccugaagugccgccugcggauggacaagcuccagcugaaggggaugagcuacuccaugugcaccggcaaguucaagaucgucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggccgagcccccguucggcgacagcuacaucaucaucgggguggagcccggccagcugaagcucaacugguucaagaagggguccagcaucggccagauguucgagaccaccaugcgcggcgccaagcggauggccauccugggggacacggcgugggacuucggcucccucggcgggguguucaccagcaucgggaaggcccuccaccaggucuucggggccaucuacggcgccgcguucuccggggugagcuggaccaugaagauccugaucggcgugaucaucaccuggaucgggaugaacucccgcagcacgucccugagcgucucccuggugcucgugggcgucaucacccuguaccugggggccauggugcaggccgacagcggcugcguggucuccuggaagaacaaggagcucaagugcggcagcgggaucuucaucaccgacaacgugcacaccuggacggagcaguacaaguuccagcccgagucccccagcaagcuggccagcgccauccagaaggcgcacgaggagggcaucugcgggauccgguccgugacccgccuggagaaccucauguggaagcagaucaccccggagcugaaccacauccugagcgagaacgaggucaagcucaccaucaugacgggcgacaucaaggggaucaugcaggccggcaagcggucccugcgcccccagcccaccgagcugaaguacagcuggaagaccuggggcaaggccaagaugcucuccaccgagagccacaaccagacguuccugaucgacgggccggagaccgccgagugccccaacaccaaccgggccuggaacucccuggagguggaggacuacggcuucgggguguucaccacgaacaucuggcucaagcugcgcgagaagcaggacgucuucugcgacagcaagcugauguccgcggccaucaaggacaaccgggccgugcacgccgacaugggcuacuggaucgagagcgcccucaacgacaccuggaagauggagaaggcguccuucaucgaggucaagagcugccacuggcccaagucccacacccuguggagcaacggcgugcuggaguccgagaugaucauccccaagagcuucgccgggccggugucccagcacaacuaccgccccggcuacuacacccagaccgccgggcccuggcaccucggcaagcuggagauggacuucgacuucugcgaggggacgaccguggucgugaccgaggacugcggcaaccggggccccagccugcgcaccacgaccgccagcgggaagcucaucaccgaguggugcugccgguccugcacccugccgccccugcgcuaccggggcgaggacgggugcugguacggcauggagauccgcccccucaaggagaaggaggagaaccuggugaacagccuggucacggcggggcacggccagaucgacaacuucucccucggcgugcuggggauggcccuguuccucgaggagaugcugcggacccgcgugggcaccaagcacgccauccugcucgucaccgugagcuucgugacgcugaucaccgggaacauguccuuccgggaccugggccgcgucauggugauggugggggccgccaugaccgacgacaucggcaugggcgucaccuaccucgcgcugcuggccgccuucaaggugcgccccacguucgccgccgggcuccugcugcggaagcucaccagcaaggagcugaugauggcgaccaucggcaucgcccugcucucccagagcaccaucccggagacgauccuggagcugaccgacgcccucgcccuggggaugauggugcugaagaucguccgcaacauggagaaguaccagcucgccgugaccaucauggcgaucuccugcgugcccaacgccgucauccugcagaacgccuggaaggugagcugcaccauccuggccgcgguguccgucagccccaugcuccugacguccagccagcagaaggccgacuggaucccccuggcccucaccaucaagggccugaacccgaccgccaucuuccugaccacgcucucccggaccagcaagaagcgcuccuggccccugaacgaggccaucauggcggugggcauggucagcauccuggccuccagccuccugaagaacgacauccccaugaccgggccccugguggccggcgggcuccugaccgugugcuacguccugacgggccggagcgccgaccucgagcuggagcgcgccaccgacgugaagugggaggaccaggcggagaucuccgggagcuccccgauccugagcaucaccaucgccgaggacggcuccaugagcaucaagaacgaggaggaggagcagacccucacgauccugauccggaccggccugcucgugaucuccgggcuguuccccgucagcauccccaucaccgccgccgccugguaccugugggaggugaagaagcagcgcgcgggcgugcucugggacguccccuccccgccgcccguggggaaggccgagcuggaggacggcgccuaccggaucaagcagaaggggauccugggcuacagccagaucggcgccgggguguacaaggagggcaccuuccacaccauguggcacgucacgcgcggggccgugcucaugcaccggggcaagcgcaucgagccguccugggcggacgugaagaaggaccugaucagcuacgggggcggcuggaagcuggagggggaguggaaggagggcgaggagguccaggugcucgcccuggagcccgggaagaacccccgggccgugcagaccaagcccggccuguucaagaccaacaccgggacgaucggcgccgucucccucgacuucagcccgggcaccuccgggagccccaucguggaccgcaagggcaagguggucgggcuguacggcaacggcguggugacccgguccggggcguacgucagcgccaucgcccagaccgagaaguccaucgaggacaaccccgagaucgaggacgacaucuuccgcaagaagcggcugacgaucauggaccuccaccccggcgccgggaagaccaagcgcuaccugccggccaucgugcgggaggcgaucaagcgcggccugcggacccugauccucgcccccacccgcguggucgccgccgagauggaggaggcccugcgcgggcugcccauccgguaccagacgcccgcgauccgcgccgagcacaccggccgggagaucguggaccucaugugccacgccaccuucaccaugcgccugcugagcccggugcggguccccaacuacaaccucaucaucauggacgaggcccacuucacggaccccgccagcaucgcggcccgcggcuacaucuccacccggguggagaugggggaggccgccggcaucuucaugaccgcgacgccgcccgggagccgcgaccccuucccccaguccaacgcccccaucauggacgaggagcgggagauccccgagcgcagcuggaacuccggccacgagugggugacggacuucaaggggaagaccgucugguucgugcccagcaucaaggccggcaacgacaucgccgccugccugcggaagaacggcaagaaggugauccagcugucccgcaagaccuucgacagcgaguacgucaagacccggacgaacgacugggacuucguggugaccaccgacaucuccgagaugggggcgaacuucaaggccgagcgcgucaucgacccccggcgcugcaugaagcccgugauccucaccgacggcgaggagcgggugauccuggccgggccgaugcccgucacgcacagcuccgccgcccagcgccggggccgcaucgggcgcaaccccaagaacgagaacgaccaguacaucuacaugggcgagccccuggagaacgacgaggacugcgcgcacuggaaggaggccaagaugcuccuggacaacaucaacaccccggagggcaucauccccagcauguucgagcccgagcgggagaagguggacgccaucgacggggaguaccgccugcggggcgaggcccgcaagaccuucguggaccucaugcggcgcggggaccugccggucuggcuggccuaccggguggcggccgagggcaucaacuacgccgaccgccgguggugcuucgacggggugaagaacaaccagauccucgaggagaacgucgagguggagaucuggaccaaggagggcgagcgcaagaagcugaagccccgguggcuggacgcccgcaucuacuccgacccccucgcgcugaaggaguucaaggaguucgccgccggccgcaagagccugacgcucaaccugaucaccgagauggggcgccugcccaccuucaugacccagaaggcccgggacgcccucgacaaccuggcggugcugcacacggccgaggccggcgggcgcgccuacaaccacgcccucuccgagcugccggagacccuggagacccuccugcugcucacccugcuggcgacggucaccggcggcaucuuccucuuccugaugagcgggaagggcguggggaagaugacccugggcaugugcugcaucaucaccgccuccauccuccugugguacgcccagauccagccccacuggaucgccgccagcaucauccuggaguucuuccucaucguccugcugauccccgagcccgagaagcagcggaccccgcaggacaaccagcucacguacguggugaucgcgauccugaccgucguggccgccaccauggccaacgagaugggguuccuggagaagaccaagaaggaccucggccugggcuccaucgccacgcaggagcccgagagcaacauccuggacaucgaccuccgccccgcgagcgccuggacccuguacgccguggccaccaccuucgucacgcccaugcugcggcacuccaucgagaacagcuccgugaacgugagccucaccgcgaucgccaaccaggccaccguccugauggggcugggcaagggguggccgcucuccaagauggacaucggcgugccccugcuggccaucgggugcuacagccaggugaaccccaucacccucacggccgcgcugcugcuccuggucgcccacuacgccaucaucggccccggccugcaggccaaggccacccgcgaggcgcagaagcgggccgccgccgggaucaugaagaacccgaccguggacggcgugaccgucaucgaccucgaccccauccccuacgaccccaaguucgagaagcagcugggccaggugaugcugcucauccugugcgugacgcagguccugaugaugcgcaccaccugggcccucugcgaggcgcugacccuggccacgggcccgaucuccacccucugggaggggaaccccggccgcuucuggaacaccaccaucgccgugagcauggccaacaucuuccggggcuccuaccuggcgggggccggccuccuguucagcaucaugaagaacacgaccaacacccgccgggggaccggcaacaucggcgagacgcugggggagaaguggaagucccgccugaacgcccucggcaagagcgaguuccagaucuacaagaaguccgggauccaggagguggaccggacccuggccaaggagggcaucaagcgcggggagaccgaccaccacgccgucagccggggcuccgcgaagcugcgcugguucguggagcggaacauggugacccccgagggcaaggucguggaccucgggugcggccgcgggggcuggagcuacuacugcgggggccugaaggacgugcgggaggucaagggccugacgaagggcgggcccgggcacgaggagccgauccccauguccaccuacggcuggaaccucgugcgccugcagagcgggguggacgucuucuucacgccgcccgagaagugcgacacccugcucugcgacaucggcgaguccagcccgaaccccacgaucgaggccggccggacccugcgcgugcugagccucguggagaacuggcugaacaacgacacccaguucugcaucaagguccugaaccccuacaugccguccgugaucgagaagauggagacccuccagcggaaguacgggggcgcccuggugcgcaacccccugagccggaacuccacccacgagauguacugggucagcaacgccacggggaacaucguguccagcgugaacaugaucucccgcaugcugaucaaccgguucaccaugaagcacaagaaggccaccuacgagcccgacgucgaccucggcagcgggacccgcaacaucggcaucgaguccgagauccccaaccuggacaucaucggcaagcgcaucgagaagaucaagcaggagcacgagacgagcuggcacuacgaccaggaccacccguacaagaccugggcguaccacggguccuacgagaccaagcagaccggcagcgccuccagcauggugaacggggugguccggcugcucacgaagcccugggacguggugcccauggucacccagauggccaugaccgacaccacgcccuucggccagcagcgcguguucaaggagaagguggacacccggacccaggagccgaaggagggcaccaagaagcugaugaagaucacggccgaguggcuguggaaggagcucgggaagaagaagacgccccggaucugcacccgggaggaguucacccgcaagguccgguccaacgccgcgcugggcgccaucuucacggacgagaacaaguggaaguccgcccgcgaggccguggaggacucccgguucugggagcugguggacaaggagcgcaaccuccaccuggaggggaagugcgagaccugcgucuacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcgggguggagggcgaggggcugcacaagcucggcuacauccugcgggacgucuccaagaagggcgggggcgccauguacgcggacgacaccgccgggugggacacccgcaucacgcuggaggaccucaagaacgaggagauggugaccaaccacauggagggcgagcacaagaagcuggccgaggccaucuucaagcugaccuaccagaacaaggugguccgggugcagcgccccacgccccgggggacggugauggacaucaucagccgccgggaccagcgcggcuccggccaggucgggaccuacggccucaacaccuucaccaacauggaggcccagcugauccgccagauggagggggagggcguguucaagagcauccagcggcugacggugaccgaggagaucgcgguccagaacuggcucgcccgcgugggccgggagcgccugucccggauggccaucagcggggacgacugcguggucaagccgcuggacgaccgcuucgccuccgcccucaccgcgcugaacgacaugggcaaggugcggaaggacauccagcagugggagcccagccgcggguggaacgacuggacccaggugcccuucugcucccaccacuuccacgagcugaucaugaaggacggccggguccucguggugcccugccgcaaccaggacgagcugaucgggcgggcccgcaucagccagggcgccggcuggucccugaaggagacggccugccucggcaagagcuacgcccagauguggucccugauguacuuccaccggcgcgaccugcggcucgcggccaacgccaucugcagcgccgucccgucccacugggugcccaccagccgcaccaccugguccauccacgcgaagcacgaguggaugaccacggaggacaugcugaccguguggaaccgggucuggauccaggagaaccccuggauggaggacaagacccccguggagagcugggaggaggugccguaccugggcaagcgcgaggaccaguggugcgggagccucaucggccugaccucccgggccacgugggccaagaacauccagaccgccaucaaccagguccgcagccugaucgggaacgaggaguacaccgacuacaugcccuccaugaagcgcuuccggcgcgaggaggaggaggccggcgugcucugguga

SEQ ID NO: 9670 - RNA, 9876 nt, Artificial Sequence
  derived and/or modified CDS sequence (opt1) from DENV-2__KC762665__SS-prME
accgccgggaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccaccuacuuccagcgggugcugaucuucauccuccugacggccgugacccccuccaugaccaugcgcugcaucgggaucagcaaccgggacuucgucgagggcguguccggcgggagcuggguggacaucguccuggagcacggcuccugcgugaccacgauggcgaagaacaagcccacccucgacuucgagcugaucaagaccgaggccaagcaccccgccacccugcgcaaguacugcaucgaggccaagcucacgaacaccaccaccgccagccggugcccgacgcagggggagcccucccugaacgaggagcaggacaagcgcuucgugugcaagcacagcauggucgaccggggcuggggcaacgggugcggccuguucgggaagggcgggaucgugaccugcgcgauguucacgugcaagaagaacauggagggcaagaucgugcagcccgagaaccucgaguacaccaucgucaucacgccccacuccggcgaggagaacgccguggggaacgacaccggcaagcacgggaaggagaucaaggugaccccgcagagcuccaucaccgaggccgagcugaccggcuacgggacggucaccauggagugcagcccccgcaccggccuggacuucaacgagauggugcuccugcagauggagaacaaggccuggcuggugcaccggcagugguuccucgaccugccccugcccuggcucccgggcgccgacacccagggguccaacuggauccagaaggagacgcuggucaccuucaagaacccccacgcgaagaagcaggacguggucgugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaagguggucaaggagaucgccgagacccagcacggcacgaucgugauccgcgugcaguacgagggggacggcagccccugcaagauccccuucgagaucauggaccuggagaagcggcacguccugggccgccucaucaccgugaacccgaucgugaccgagaaggacucccccgucaacaucgaggcggagccgcccuucggggacagcuacaucaucaucggcguggagccggggcagcugaagcuguccugguucaagaagggcagcuccaucgggcagauguucgagaccacgaugcgcggcgccaagcggauggccauccucggcgacaccgccugggacuucgggagccugggcgggguguucaccuccaucggcaaggcccugcaccaggucuucggggcgaucuacggcgccgccuucagcggcguguccuggaccaugaagauccucaucgggguggucaucacguggaucggcaugaacagccgcuccaccagccuguccgugagccuggugcuggucgggguggugacccucuaccugggcgucauggugcaggccgacuccgggugcguggucagcuggaagaacaaggagcugaagugcggcagcggcaucuucaucaccgacaacgugcacacguggaccgagcaguacaaguuccagcccgagucccccagcaagcucgcguccgccauccagaaggcccacgaggaggggaucugcggcauccggagcgugacccgccuggagaaccugauguggaagcagaucacccccgagcucaaccacauccuguccgagaacgaggucaagcugacgaucaugaccggggacaucaagggcaucaugcaggccgggaagcggagccuccgcccgcagcccaccgagcugaaguacuccuggaagaccuggggcaaggccaagaugcugagcacggagcuccacaaccacaccuuccugaucgacggccccgagaccgcggagugcccgaacgccaaccgggccuggaacucccuggagguggaggacuacggguucggcguguucaccacgaacaucuggcucaagcugaaggagcgccaggacgccuucugcgacagcaagcugauguccgccgcgaucaaggacaaccgggccguccacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcacgaccgugguggucaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggugacggccggccacgggcagaucgacaacuucagccucggcguccugggcauggcgcuguuccucgaggagaugcugcgcacccggguggggaccaagcacgccauccugcucguggccgucuccuucgugacccugaucacgggcaacaugagcuuccgcgaccuggggcgcgugauggucauggugggcgccaccaugaccgacgacaucgggaugggcgugaccuaccucgcccugcuggcggccuucaagguccggcccacguucgccgccggccuccugcugcgcaagcucaccuccaaggagcugaugaugaccaccaucgggaucacgcugcucagccaguccaccauccccgagaccauccuggagcugaccgacgcccucgcgcugggcaugauggugcugaagaucgugcggaacauggagaaguaccagcucgccgucacgaucauggccauccugugcgugccgaacgccgucauccugcagaacgccuggaaggugagcugcaccacccucgcgguggucuccgugagcccccugcugcucaccuccagccagcagaaggccgacuggaucccccuggcccugacgaucaaggggcucaaccccaccgccaucuuccugaccacccugucccgcacgagcaagaagcgguccuggccgcucaacgaggcgaucauggccgugggcauggucagcauccuggccuccagccugcucaagaacgacauccccaugaccggcccccugguggccgggggccugcucaccgugugcuacguccugaccgggcgcagcgccgaccuggagcucgagcgggcggccgacgugcgcugggaggagcaggccgagaucuccggcagcucccccauccugagcaucacgaucuccgaggacgggagcauguccaucaagaacgaggaggaggagcagacccugaccauccucauccggaccggccugcuggugaucagcggccucuucccggucuccauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacucccagaucggcgccggcguguacaaggaggggacguuccacaccauguggcacgucacccgcggcgcggugcugaugcacaaggggaagcggaucgagcccagcugggccgacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagacgagcaccggcaccaucggggccgucucccuggacuucagccccggcaccuccggcagccccaucguggacaagaaggggaagguggucggccucuacgggaacggcguggugacgcgguccggcaccuacgucagcgcgaucgcccagaccgagaaguccaucgaggacaaccccgagaucgaggacgacaucuuccgcaagaagcggcugaccaucauggaccugcaccccggggccggcaagacgaagcgcuaccugcccgccaucgugcgggaggcgaucaagcgcgggcuccggacccugauccuggccccgacccgcguggucgccgccgagauggaggaggcccuccgcggccugcccauccgguaccagacccccgcgauccgcgccgagcacacggggcgggagaucguggaccugaugugccacgccaccuucaccaugcgccuccugucccccauccgggugccgaacuacaaccugaucaucauggacgaggcccacuucaccgaccccgccagcaucgcggcccgcggcuacaucuccacgcgggucgagaugggcgaggccgccgggaucuucaugaccgccacgccgcccggcagccgcgacccguucccccaguccaacgcgcccaucauggacgaggagcgggagauccccgagcgcagcuggaacuccgggcacgagugggugaccgacuucaagggcaagacggugugguucgucccgagcaucaaggccgggaacgacaucgccgccugccuccggaagaacggcaagaaggugauccagcugucccgcaagaccuucgacuucgaguacaucaagacccggaccaacgacugggacuucguggucacgaccgacaucagcgagaugggcgcgaacuucaaggccgagcgcgugaucgacccccggcgcugcaugaagcccgugauccugaccgacggggaggagcgggucauccucgccggccccaugccggugacccacuccagcgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacgcccgagggcaucaucccguccauguucgagcccgagcgggagaaggucgacgccaucgacggcgaguaccgccugcgcggggaggcccgcaagaccuucguggaccugaugcggcgcggcgaccuccccguguggcuggccuaccgggucgcggccgaggggaucaacuacgccgaccgccgguggugcuucgacggcgugaagaacaaccagauccuggaggagaacgucgagguggagaucuggaccaaggagggggagcgcaagaagcucaagccgcgguggcuggacgcccgcaucuacagcgacccccuggcccucaaggaguucaaggaguucgcggccggccggaagucccugacccugaaccucaucacggagaugggccgccugcccaccuucaugacccagaaggcccggaacgcccuggacaaccucgcggugcugcacaccgccgaggccgggggccgcgccuacaaccacgcccugagcgagcuccccgagacgcuggagacccugcuccugcugacccuccuggcgaccgucaccgggggcaucuuccuguuccucauguccggcaaggggaucggcaagaugacgcuggggaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugaccuacguggucaucgcgauccucacggugguggccgccaccauggccaacgagaugggcuuccuggagaagaccaagaaggacuucgggcugggcagcaucaccacgcagcagccggagagcaacauccucgacaucgaccugcgccccgccuccgcguggacccuguacgccgucgccaccaccuucaucacgcccaugcuccggcacagcaucgagaacuccagcgugaacgugucccugaccgccaucgccaaccaggcgaccguccugaugggccucgggaagggcuggccccugagcaagauggacaucggggugccgcugcucgccaucggcugcuacucccaggugaaccccaucacccugacggccgcccugcuccugcuggucgcgcacuacgccaucaucgggcccggccuccaggccaaggccacccgcgaggcccagaagcgggcggccgccggcaucaugaagaaccccaccguggacgggaucaccgugaucgaccuggacccgauccccuacgaccccaaguucgagaagcagcugggccaggucaugcuccuggugcugugcgugacgcagguccucaugaugcgcaccaccugggcccugugcgaggcccugacccucgcgacggggcccaucagcacccugugggagggcaacccggggcgcuucuggaacaccaccaucgccguguccauggccaacaucuuccggggcagcuaccuggccggcgccgggcuccuguucuccaucaugaagaacacggcgaacacccgccggggcaccgggaacaccggcgagacgcugggcgagaaguggaagaaccgccucaacgcccugggcaagagcgaguuccagaucuacaagaaguccggcauccaggagguggaccggacccuggccaaggaggggaucaagcgcggcgagaccgaccaccacgccgucagccggggguccgcgaagcuccgcugguucguggagcggaaccugguggcccccgagggcaaggucguggaccugggcugcgggcgcggcggguggagcuacuacugcggcgggcucaagaacgugaaggaggucaagggccugaccaagggcgggcccggccacgaggagcccaucccgauguccacguacggguggaaccuggugcggcuccagagcggcguggacgucuucuucacgccgcccgagaagugcgacacccugcugugcgacaucggggaguccagccccaacccgaccguggaggccggccgcacccuccgggugcugaaccuggucgagaacuggcucaacaacaacacgcaguucugcaucaaggugcugaaccccuacaugcccagcgugaucgagaagauggaggcccugcagcgcaaguacggcggggcccugguccggaacccgcucucccgcaacagcacccacgagauguacuggguguccaacgcgagcggcaacaucguguccagcgucaacaugaucucccggaugcugaucaaccgcuucaccaugcggcacaagaaggccaccuacgagcccgacguggaccuggggagcggcacgcgcaacaucgggaucgaguccgagacccccaaccucgacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgucgugcggcugcugaccaagccgugggacgugauccccauggucacccagauggccaugacggacaccacccccuucgggcagcagcgcguguucaaggagaagguggacacccggacgcaggagcccaaggagggcaccaagaagcucaugaagaucaccgcggaguggcuguggaaggagcugggcaagaagaagaccccgcgcaugugcacgcgggaggaguucacccgcaagguccgguccaacgccgcccucggggccaucuucaccgacgagaacaaguggaaguccgcccgcgaggcgguggaggacuccggcuucugggagcuggucgacaaggagcggaaccugcaccucgaggggaagugcgagaccugcguguacaacaugaugggcaagcgcgagaagaagcugggggaguucggcaaggccaagggcagccgggccaucugguacauguggcugggggcccgcuuccucgaguucgaggcgcugggcuuccugaacgaggaccacugguucucccgggagaacagccucagcgggguggagggcgaggggcugcacaagcugggcuacauccuccgcgacgucuccaagaaggagggcggggccauguacgccgacgacacggccggcugggacacccggaucacccuggaggaccugaagaacgaggagauggugaccaaccacauggagggggagcacaagaagcucgccgaggcgaucuucaagcugacguaccagaacaaggugguccgcgugcagcggcccacgccccggggcaccgugauggacaucaucagccggcgcgaccagcggggguccggccaggucgugaccuacggccugaacacguucaccaacauggaggcccagcucauccgccagauggagggggagggcguguucaagagcauccagcagcugaccgucaccgaggagaucgccgugaagaacuggcuggugcgcgucgggcgggagcgccucucccggauggccaucagcggcgacgacugcguggugaagccccuggacgaccgcuucgccuccgcgcugacggcccucaacgacaugggcaagguccggaaggacauccagcagugggagccgagccgcggguggaacgacuggacccaggugcccuucugcucccaccacuuccacgagcugaucaugaaggacggccgggugcuggucgugcccugccgcaaccaggacgagcucaucgggcgggcccgcaucagccagggcgccggguggucccugcgggagaccgccugccugggcaagagcuacgcgcagauguggucccucauguacuuccaccgccgggaccugcgccuggccgccaacgccaucugcagcgccgugcccucccacugggucccgaccagccggaccacgugguccauccacgcgacccacgaguggaugaccaccgaggacaugcucacgguguggaaccgcguguggauccaggagaaccccuggauggaggacaagacccccgucgagagcugggaggagauccccuaccugggcaagcgggaggaccaguggugcgggagccugaucggccucaccucccgcgccaccugggccaagaacauccagacggccaucaaccaggugcggagccugaucgggaacgaggaguacaccgacuacaugccguccaugaagcgcuuccgccgggaggaggaggaggcgggcgugcugugguga

SEQ ID NO: 9671 - RNA, 9876 nt, Artificial Sequence
  derived and/or modified CDS sequence (opt1) from DENV-2__KC762669__SS-prME
accgccggcaucaucaucauggugauccccaccgucauggccuuccaccugaccacccgcaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggucaccuacgggaccugcaccgccaccggcgagcaccggcgcgagaagcggagcguggcccuggugccccacgucggcauggggcuggagacccgcaccgagaccuggauguccagcgagggcgccuggaagcacgcccagcggaucgagaccugggugcuccgccacccgggguucaccaucauggcggccauccuggccuacaccaucggcaccaccuacuuccagcgggugcugaucuucauccuccugaccgccgucgcgcccuccaugaccaugcgcugcaucgggaucagcaaccgggacuucguggagggcguguccggcgggagcugggucgacaucgugcuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgucugcaagcacagcaugguggaccggggcuggggcaacgggugcggccuguucgggaagggcgggaucgugacgugcgccauguucacgugcaagaagaacauggagggcaagaucguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgugauggugcaggcggacuccgggugcgucgugagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgucacccgccuggagaaccugauguggaagcagaucacccccgagcucaaccacauccuguccgagaacgaggugaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggagguggaggacuacggguucggcgucuucaccaccaacaucuggcucaagcugaaggagcgccaggacguguucugcgacagcaagcugauguccgccgcgaucaaggacaaccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcaccacggucguggugaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggucaacucccuggugaccgccggccacgggcagaucgacaacuucagccucggcgugcugggcauggcgcuguuccucgaggagaugcugcgcacgcgggucgggaccaagcacgccauccugcucguggccguguccuucgucacccugaucaccggcaacaugagcuuccgcgaccuggggcgcgugauggugauggucggcgccacgaugaccgacgacaucgggaugggcgugaccuaccucgcccugcuggcggccuucaaggugcggcccaccuucgccgccggccuccugcugcgcaagcucacguccaaggagcugaugaugaccaccaucgggaucguccugcucagccaguccaccauccccgagacgauccuggagcugaccgacgcccucgcgcugggcaugauggugcugaagaucguccggaacauggagaaguaccagcucgccgugaccaucauggccauccugugcgugccgaacgccgucauccugcagaacgccuggaaggugagcugcaccacgcucgcgguggucuccgugagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgugggcauggucagcauccuggccuccagccugcucaagaacgacauccccaugaccggcccccugguggccgggggccugcucacggugugcuacguccugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccggucuccauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacucccagaucggcgccggcguguacaaggaggggaccuuccacaccauguggcacgucacgcgcggcgcggugcugaugcacaaggggaagcggaucgagcccagcugggccgacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagaccaacaccggcaucaucggggccgucagccuggacuucucccccggcacgagcggcucccccaucguggacaagaaggggaagguggucggccucuacgggaacggcguggugacccggagcggcaccuacgucuccgcgaucgcccagaccgagaaguccaucgaggacaaccccgagaucgaggacgacaucuuccgcaagaagcggcugacgaucauggaccugcaccccggggccggcaagaccaagcgcuaccugcccgccaucgugcgggaggcgaucaagcgcgggcuccggacccugauccuggccccgacccgcguggucgccgccgagauggaggaggcccuccgcggccugcccauccgguaccagacgcccgcgauccgcgccgagcacaccgggcgggagaucguggaccugaugugccacgccaccuucaccaugcgccuccugagccccauccgggugccgaacuacaaccugaucaucauggacgaggcccacuucacggaccccgccuccaucgcggcccgcggcuacaucagcacccgggucgagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugacggacuucaagggcaagaccgugugguucgucccguccaucaaggccgggaacgacaucgccgccugccuccggaagaacggcaagaaggugauccagcugagccgcaagaccuucgacuucgaguacaucaagacccggacgaacgacugggacuucguggucaccaccgacaucuccgagaugggcgcgaacuucaaggccgagcgcgugaucgacccccggcgcugcaugaagcccgugauccugaccgacggggaggagcgggucauccucgccggccccaugccggugacgcacagcuccgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccgagcauguucgagcccgagcgggagaaggucgacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgugaagaacaaccagauccuggaggagaacgucgagguggagaucuggaccaaggagggggagcgcaagaagcucaagccgcgguggcuggacgcccgcaucuacuccgacccccuggcccucaaggaguucaaggaguucgcggccggccgcaagagccugacgcugaaccucaucaccgagaugggccgccugcccaccuucaugacccagaaggcccggaacgcccuggacaaccucgcggugcugcacacggccgaggccgggggccgcgccuacaaccacgcccuguccgagcuccccgagacccuggagacccugcuccugcugacccuccuggcgacggucaccgggggcaucuuccuguuccucaugagcggcaaggggaucggcaagaugacccuggggaugugcugcaucaucaccgccuccauccugcucugguacgcccagauccagccgcacuggaucgccgccagcaucauccuggaguucuuccugaucgugcuccugauccccgagcccgagaagcagcggacgccccaggacaaccagcugacguacguggucaucgcgauccucaccgugguggccgccaccauggccaacgagaugggcuuccuggagaagaccaagaaggacuucgggcugggcuccaucacgacccagcagcucgagagcaacauccuggacaucgaccugcgcccggccagcgcguggacccucuacgccgucgccaccacguucaucacccccaugcugcggcacuccaucgagaacagcuccgugaacgugagccugaccgccaucgccaaccaggcgaccguccucaugggccuggggaagggcuggccccuguccaagauggacaucggggugccccuccuggccaucggcugcuacagccaggugaacccgaucacgcugaccgccgcccuccugcugcucgucgcgcacuacgccaucaucgggcccggccugcaggccaaggccacccgcgaggcccagaagcgggcggccgccggcaucaugaagaaccccaccguggacgggaucacggugaucgaccuggaccccaucccguacgaccccaaguucgagaagcagcucggccaggucaugcugcuggugcucugcgugacccagguccugaugaugcgcaccaccugggcccugugcgaggcccucacgcuggcgaccgggcccaucuccacccugugggagggcaaccccgggcgcuucuggaacaccacgaucgccgugagcauggccaacaucuuccggggcuccuaccucgccggcgccgggcugcuguucagcaucaugaagaacaccgcgaacacccgccggggcaccgggaacacgggcgagacccucggcgagaaguggaagaaccgccugaacgcccuggggaaguccgaguuccagaucuacaagaaguccggcauccaggagguggaccggacccucgccaaggaggggaucaagcgcggcgagaccgaccaccacgccgucucccgggggagcgcgaagcugcgcugguucguggagcggaaccuggugacgccggagggcaaggucguggaccucggcugcgggcgcggcgggugguccuacuacugcggcgggcugaagaacgugaaggaggucaagggccugaccaagggcgggcccggccacgaggagcccauccccaugagcaccuacggguggaaccucgugcggcugcaguccggcguggacgucuucuucaccccgcccgagaagugcgacacgcugcucugcgacaucggggagagcucccccaaccccaccguggaggccggccgcacccugcgggugcugaaccucgucgagaacuggcugaacaacaacacccaguucugcaucaaggugcugaacccguacaugcccagcgugaucgagaagauggaggcccugcagcgcaaguacggcggggcccucguccggaacccccugagccgcaacuccacccacgagauguacugggugagcaacgccuccggcaacaucgugagcuccgucaacaugaucagccggaugcugaucaaccgcuucacgaugcggcacaagaaggcgaccuacgagccggacguggaccucggguccggcacccgcaacaucgggaucgagagcgagacccccaaccuggacaucaucggcaagcgcaucgagaagaucaagcaggagcacgagacguccuggcacuacgaccaggaccaccccuacaagaccugggccuaccacggcagcuacgagaccaagcagaccggguccgccagcuccauggugaacggcgucgugcggcugcucacgaagcccugggacgugaucccgauggucacccagauggccaugaccgacaccacgcccuucgggcagcagcgcguguucaaggagaaggucgacacccggacccaggagcccaaggagggcaccaagaagcugaugaagaucacggccgaguggcuguggaaggagcucggcaagaagaagacgccccggaugugcacccgggaggaguucacccgcaaggugcggagcaacgcggcccugggggccaucuucacggacgagaacaaguggaaguccgcccgcgaggccguggaggacagcggcuucugggagcuggucgacaaggagcggaaccuccaccuggaggggaagugcgagaccugcguguacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggagaacucccugagcgggguggagggcgaggggcugcacaagcucggcuacauccugcgcgacgucagcaagaaggagggcggggcgauguacgccgacgacaccgccggcugggacacccggaucacgcuggaggaccucaagaacgaggagauggugaccaaccacauggagggggagcacaagcgccuggccgaggccaucuuccggcugaccuaccagaacaaggugguccgcgugcagcggccgacgccccggggcacggugauggacaucaucucccggcgcgaccagcgcgggagcggccaggucgugaccuacggccucaacaccuucaccaacauggaggcgcagcugauccggcagauggagggggagggcguguucaaguccauccagcaccugacggucaccgaggagaucgccgugaagaacuggcucgcccgcguggggcgggagcgccugagccggauggccaucuccggcgacgacugcgucgugaagccccuggacgaccgcuucgccagcgcgcucaccgcccugaacgacaugggcaaggugcggaaggacauccagcagugggagcccucccgcggguggaacgacuggacccaggucccguucugcagccaccacuuccacgagcugaucaugaaggacggccgggugcucgugguccccugccgcaaccaggacgagcugaucgggcgggcccgcaucucccagggcgccggguggagccugcgggagacggccugccucggcaaguccuacgcgcagauguggagccugauguacuuccaccgccgggaccugcgccucgccgccaacgccaucugcuccgccgugcccagccacugggugcccaccucccggaccaccuggagcauccacgcgacccacgaguggaugacgaccgaggacaugcugaccgucuggaaccgcguguggauccaggagaacccguggauggaggacaagacccccguggaguccugggaggagauccccuaccugggcaagcgggaggaccaguggugcgggagccucaucggccugacgagccgcgccaccugggccaagaacauccagaccgccaucaaccagguccgcucccugaucgggaacgaggaguacaccgacuacaugcccagcaugaagcgguuccgccgggaggaggaggaggcgggcgugcucugguga

SEQ ID NO: 9672 - RNA, 9876 nt, Artificial Sequence
  derived and/or modified CDS sequence (opt1) from DENV-2__KC762658__SS-prME
accgccggcaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgcccccggcgagcaccggcgcgagaagcggagcgucgcccuggugccgcacgugggcauggggcuggagacccgcaccgagaccuggauguccagcgagggcgccgggaagcacgcccagcggaucgagaccuggguccuccgccaccccggcuucaccaucauggcggccauccuggccuacaccaucgggaccaccuacuuccagcgggugcugaucuucauccuccugaccgccgugacccccuccaugaccaugcgcugcaucggcaucagcaaccgggacuucgucgagggcguguccgggggcagcuggguggacaucguccuggagcacggguccugcgugaccaccauggcgaagaacaagcccacgcucgacuucgagcugaucaagaccgaggccaagcugccggccacccuccgcaaguacugcaucgaggccaagcugaccaacacgaccaccgccagccggugccccacccagggcgagcccucccugaacgaggagcaggacaagcgcuucgugugcaagcacagcauggucgaccggggcugggggaacggcugcgggcuguucggcaagggcgggaucgugacgugcgcgauguucacgugcaagaagaacauggagggcaagaucgugcagcccgagaaccuggaguacaccaucgucaucaccccgcacuccggggaggagaacgccgugggcaacgacacggggaagcacggcaaggagaucaaggugacgccccagagcuccaucaccgaggccgagcugaccggguacggcaccgucacgauggagugcagcccccgcaccggccucgacuucaacgagauggugcugcugcagauggagaacaaggccuggcucgugcaccggcagugguuccuggaccugccccucccguggcugcccggggccgacacccagggcuccaacuggauccagaaggagacccuggucacguucaagaacccccacgcgaagaagcaggacguggucgugcucgggagccaggagggcgccaugcacaccgcccugaccggggccaccgagauccagaugagcuccggcaaccuccuguucacgggccaccugaagugccgccugcggauggacaagcuccagcugaaggggaugagcuacuccaugugcaccggcaaguucaagguggucaaggagaucgccgagacccagcacgggaccaucgugauccgcgugcaguacgagggcgacggcagccccugcaagaucccguucgagaucauggaccuggagaagcggcacguccucgggcgccugaucacggugaaccccaucgugaccgagaaggacucccccgucaacaucgaggcggagcccccguucggcgacagcuacaucaucaucgggguggagcccggccagcugaagcucuccugguucaagaaggggagcuccaucggccagauguucgagaccaccaugcgcggcgccaagcggauggccauccugggggacacggccugggacuucggcagccucggcgggguguucaccuccaucgggaaggcccuccaccaggucuucggggcgaucuacggcgccgccuucagcgggguguccuggaccaugaagauccugaucggcguggucaucaccuggaucgggaugaacagccgcuccacgagccuguccgugagccuggugcucgucggcguggugacccuguaccugggggucauggugcaggccgacuccggcugcguggucagcuggaagaacaaggagcucaagugcggcagcgggaucuucaucaccgacaacgugcacaccuggacggagcaguacaaguuccagcccgagucccccagcaagcuggcguccgccauccagaaggcccacgaggagggcaucugcgggauccggagcgugacccgccuggagaaccucauguggaagcagaucaccccggagcugaaccacauccuguccgagaacgaggucaagcucaccaucaugacgggcgacaucaaggggaucaugcaggccggcaagcggagccugcgcccccagcccaccgagcugaaguacuccuggaagaccuggggcaaggccaagaugcucagcaccgagcugcacaaccacacguuccugaucgacgggccggagaccgcggagugccccaacaccaaccgggccuggaacucccucgagguggaggacuacggcuucgggguguucaccacgaacaucuggcugaagcugaaggagcgccaggacgucuucugcgacagcaagcucauguccgccgccaucaaggacaaccgggccgugcacgcggacaugggcuacuggaucgagagcgcccugaacgacaccuggaagaucgagaaggccuccuucaucgaggucaagagcugccacuggcccaagucccacacccuguggagcaacggcgugcucgaguccgagaugaucauccccaagaacuucgccgggccggugagccagcacaacuaccgccccggcuaccacacccagaccgccgggcccuggcaccugggccggcuggagauggacuucgacuucugcgaggggacgaccguggucgugaccgaggacugcggcaaccgcggccccagccuccggaccacgaccgcguccgggaagcugaucaccgaguggugcugccgcagcugcacccugccgccccuccgguaccgcggcgaggacgggugcugguacggcauggagauccggccccugaaggagaaggaggagaaccuggugaacucccucgucacggccgggcacggccagaucgacaacuucagccugggcgugcuggggauggcccucuuccuggaggagaugcugcgcacccgggugggcaccaagcacgccauccuccuggucgcgguguccuucgugacccugaucacggggaacaugagcuuccgcgaccucggccgcgucauggugauggugggggccaccaugaccgacgacaucggcaugggcgucaccuaccuggcccugcucgccgccuucaaggugcggcccacguucgcggccgggcugcugcuccgcaagcugaccuccaaggagcugaugaugaccaccaucggcaucgugcuccugagccaguccacgaucccggagaccauccuggagcucaccgacgcccuggcccuggggaugaugguccucaagaucgugcggaacauggagaaguaccagcuggccgucaccaucauggcgauccugugcgugcccaacgccgugauccuccagaacgccuggaaggucagcugcacgacccuggccgugguguccgucagcccccugcuccugaccuccagccagcagaaggccgacuggaucccccuggcgcucaccaucaagggccugaacccgacggccaucuuccugaccacccucucccgcaccagcaagaagcgguccuggccccugaacgaggccaucauggccgugggcauggugagcauccuggcguccagccuccugaagaacgacauccccaugacggggccccuggucgccggcgggcuccugaccgugugcuacgugcugaccggccgcagcgccgaccucgagcuggagcgggccgccgacguccgcugggaggagcaggcggagaucuccgggagcuccccgauccugagcaucaccaucuccgaggacggcagcauguccaucaagaacgaggaggaggagcagacgcucaccauccugauccggaccggccugcucgugaucagcgggcuguuccccguguccauccccaucaccgccgccgccugguaccugugggaggucaagaagcagcgcgccggcgugcucugggacgugcccagcccgccgcccgucgggaaggcggagcuggaggacggcgccuaccggaucaagcagaaggggauccugggcuacucccagaucggcgccgggguguacaaggagggcaccuuccacacgauguggcacgugacccgcggggccguccucaugcacaagggcaagcggaucgagccgagcugggccgacgugaagaaggaccugaucuccuacgggggcggcuggaagcuggagggggaguggaaggagggcgaggaggugcagguccucgcgcuggagcccgggaagaacccccgcgccgugcagaccaagcccggccuguucaagaccaacacggggaccaucggcgccgugagccucgacuucuccccgggcaccagcgggucccccaucgucgacaagaagggcaaggugguggggcuguacggcaacggcgucgugacccggagcgggacguacguguccgccaucgcccagaccgagaaguccaucgaggacaaccccgagaucgaggacgacaucuuccgcaagaagcggcugaccaucauggaccugcaccccggcgcggggaagaccaagcgcuaccucccggccaucguccgggaggccaucaagcgcggccugcggacgcugauccucgcccccacccgcgugguggcggccgagauggaggaggcccugcgcgggcugcccauccgguaccagacccccgccauccgcgccgagcacaccggccgggagaucgucgaccucaugugccacgcgacguucaccaugcgccugcugagcccgauccgggugcccaacuacaaccucaucaucauggacgaggcccacuucaccgaccccgccuccaucgccgcccgcggcuacaucagcacccggguggagaugggggaggcggccggcaucuucaugacggccacgccgcccgggucccgcgaccccuucccccagagcaacgcccccaucauggacgaggagcgggagauccccgagcgcuccuggaacagcggccacgagugggucaccgacuucaaggggaagaccgugugguucgugcccuccaucaaggccggcaacgacaucgcggccugccugcggaagaacggcaagaaggucauccagcugagccgcaagacguucgacuucgaguacaucaagacccggaccaacgacugggacuucguggugaccacggacaucuccgagaugggggccaacuucaaggccgagcgcgucaucgacccccggcgcugcaugaagcccgugauccucaccgacggcgaggagcgggugauccuggcggggccgaugcccgucacccacagcuccgccgcccagcgccggggccgcguggggcgcaaccccaagaacgagaacgaccaguacaucuacaugggcgagccccuggagaacgacgaggacugcgcccacuggaaggaggccaagaugcuccuggacaacaucaacaccccggagggcaucauccccagcauguucgagcccgagcgggagaagguggacgcgaucgacggggaguaccgccugcggggcgaggcccgcaagacguucgucgagcucaugcggcgcggggaccugccgguguggcuggccuaccgggucgccgccgagggcaucaacuacgcggaccgccgguggugcuucgacggggugaagaacaaccagauccucgaggagaacguggaggucgagaucuggaccaaggagggcgagcgcaagaagcugaagccccgguggcuggacgcccgcaucuacuccgacccccucgcccugaaggaguucaaggaguucgccgccggccgcaagagccugacccucaaccugaucaccgagauggggcgccugcccacguucaugacccagaaggcgcggaacgcccucgacaaccuggccgugcugcacaccgccgaggcgggcgggcgcgccuacaaccacgcccucuccgagcugccggagacccuggagacgcuccugcugcucacccugcuggccaccgugaccggcggcaucuuccucuuccugaugagcgggaagggcaucgggaagaugacccugggcaugugcugcaucaucacggccuccauccuccugugguacgcgcagauccagccccacuggaucgccgccagcaucauccuggaguucuuccucaucguccugcugauccccgagcccgagaagcagcggaccccgcaggacaaccagcucaccuacguggugaucgccauccugaccgucguggccgcgacgauggccaacgagaugggguuccuggagaagaccaagaaggacuucggccucggcuccaucaccacccagcagcccgagagcaacauccuggacaucgaccugcgccccgccagcgccuggacgcucuacgccguggcgaccaccuucaucacccccaugcugcggcacuccaucgagaacagcuccgucaacgugagccugacggccaucgccaaccaggccaccgugcucauggggcugggcaagggguggccgcuguccaagauggacaucggcgucccccuccuggccaucgggugcuacagccaggugaaccccaucacccugaccgcggcccuccugcugcucguggcccacuacgccaucaucggccccggccugcaggcgaaggccacgcgcgaggcccagaagcgggccgccgcggggaucaugaagaacccgaccgucgacggcaucaccgugaucgaccuggaccccauccccuacgaccccaaguucgagaagcagcucggccaggugaugcugcugguccucugcgugacccaggugcugaugaugcgcacgaccugggcccugugcgaggcccucacccuggccaccggcccgaucuccacgcugugggaggggaaccccggccgcuucuggaacaccaccaucgccgucagcauggcgaacaucuuccggggcuccuaccucgccggggccggccugcuguucagcaucaugaagaacaccgccaacacgcgccgggggaccggcaacaccggcgagacccucggggagaaguggaagaaccgccugaacgcccugggcaaguccgaguuccagaucuacaagaaguccgggauccaggagguggaccggacgcucgcgaaggagggcaucaagcgcggggagaccgaccaccacgccgugucccggggcagcgccaagcugcgcugguucgucgagcggaaccuggugacccccgagggcaagguggucgaccucgggugcggccgcgggggcugguccuacuacugcgggggccugaagaacgugaaggaggugaagggccugaccaagggcgggcccgggcacgaggagccgauccccaugagcacguacggcuggaaccucguccggcugcaguccgggguggacguguucuucacgccgcccgagaagugcgacacccugcucugcgacaucggcgagagcuccccgaaccccaccgucgaggccggccgcacccugcgggugcugaaccucguggagaacuggcugaacaacaacacgcaguucugcaucaagguccugaaccccuacaugccgagcgugaucgagaagauggaggcgcugcagcgcaaguacgggggcgcccucgugcggaacccccugagccgcaacuccacccacgagauguacugggucagcaacgccuccgggaacaucgugagcuccgugaacaugaucagccggaugcugaucaaccgcuucaccaugcggcacaagaaggccaccuacgagcccgacgucgaccucggcuccgggacgcgcaacaucggcaucgagagcgagacccccaaccuggacaucaucggcaagcgcaucgagaagaucaagcaggagcacgagaccuccuggcacuacgaccaggaccacccguacaagaccugggccuaccacgggagcuacgagacgaagcagaccggcuccgcgagcuccauggugaacggggugguccggcugcucaccaagcccugggacgugauccccauggugacccagauggccaugacggacaccacccccuucggccagcagcgcgucuucaaggagaagguggacacccggacgcaggagccgaaggagggcaccaagaagcugaugaagaucaccgccgaguggcuguggaaggagcucgggaagaagaagacgccccggaugugcacgcgggaggaguucacccgcaagguccggagcaacgccgcccugggcgcgaucuucaccgacgagaacaaguggaaguccgcccgcgaggccguggaggacagcggguucugggagcugguggacaaggagcggaaccuccaccuggagggcaagugcgagaccugcgucuacaacaugauggggaagcgcgagaagaagcugggcgaguucggcaaggccaaggggucccgggccaucugguacauguggcucggcgcgcgcuuccuggaguucgaggcccugggguuccucaacgaggaccacugguucagccgggagaacucccugagcggcguggagggggagggccugcacaagcucggcuacauccugcgcgacgugagcaagaaggagggcggggccauguacgccgacgacacggcggggugggacacccggaucacccuggaggaccucaagaacgaggagauggucaccaaccacauggagggcgagcacaagaagcuggccgaggccaucuucaagcugacguaccagaacaagguggugcgcguccagcggcccacgccccgcgggaccgugauggacaucaucucccggcgcgaccagcggggcagcggccagguggucaccuacgggcucaacacguucaccaacauggaggcccagcugauccgccagauggagggcgaggggguguucaaguccauccagcagcugaccgugaccgaggagaucgccgucaagaacuggcucgugcgcgugggccgggagcgccugagccggauggcgaucuccggcgacgacugcgucgugaagccgcuggacgaccgcuucgccagcgcccucacggcccugaacgacauggggaaggugcggaaggacauccagcagugggagcccucccgcggcuggaacgacuggacccagguccccuucugcagccaccacuuccacgagcugaucaugaaggacgggcgggugcucgugguccccugccgcaaccaggacgagcugaucggccgggcccgcaucucccagggggcgggcuggagccugcgggagaccgccugccucggcaaguccuacgcccagauguggagccugauguacuuccaccgccgggaccugcgccucgccgccaacgcgaucugcuccgccgugccgagccacugggugcccaccucccggaccacguggagcauccacgccacccacgaguggaugaccaccgaggacaugcugacggucuggaaccgcguguggauccaggagaaccccuggauggaggacaagacccccguggaguccugggaggagaucccguaccuggggaagcgggaggaccaguggugcggcagccucaucgggcugaccagccgcgccaccugggccaagaacauccagacggcgaucaaccagguccggucccugaucggcaacgagaaguacaccgacuacaugcccagcaugaagcgcuuccgccgggaggaggaggaggccggggugcucugguga

SEQ ID NO: 9673 - RNA, 9876 nt, Artificial Sequence
  derived and/or modified CDS sequence (opt1) from DENV-2__KC762660__SS-prME
accgcgggcaucaucaucaugaugauccccaccgugauggccuuccaccugacgacccggaacggggagccccacaugaucgucagccggcaggagaagggcaagagccuccuguucaagaccgagaacggggugaacaugugcacccugauggcgauggaccucggcgagcugugcgaggacacgaucaccuacaacugcccccugcuccgccagaacgagcccgaggacaucgacugcuggugcaacagcaccuccaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccgugacccccuccaugaccaugcgcugcaucgggaucagcaaccgggacuucgucgagggcguguccggcgggagcuggguggacaucguccuggagcacggcuccugcgugaccacgauggcgaagaacaagcccacccucgacuucgagcugaucaagaccgaggccaagcaccccgccacccugcgcaaguacugcaucgaggccaagcucacgaacaccaccaccgccagccggugcccgacgcagggggagcccucccugaacgaggagcaggacaagcgcuucgugugcaagcacagcauggucgaccggggcuggggcaacgggugcggccuguucgggaagggcgggaucgugaccugcgcgauguucacgugcaagaagaacauggagggcaaggugguccagcccgagaaccucgaguacaccaucgugaucacgccccacuccggcgaggagaacgccguggggaacgacaccggcaagcacgggaaggagaucaaggucaccccgcagagcuccaucaccgaggccgagcugaccggcuacgggacggugaccauggagugcagcccccgcaccggccuggacuucaacgagauggugcuccugcagauggagaacaaggccuggcugguccaccggcagugguuccucgaccugccccugcccuggcucccgggcgccgacacccagggguccaacuggauccagaaggagacgcuggugaccuucaagaacccccacgcgaagaagcaggacgucguggugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaaggucgugaaggagaucgccgagacccagcacggcacgaucgugauccgcguccaguacgagggggacggcagccccugcaagauccccuucgagaucauggaccuggagaagcggcacgugcugggccgccucaucaccgugaacccgaucgucaccgagaaggacucccccgugaacaucgaggcggagccgcccuucggggacagcuacaucaucaucggcguggagccggggcagcugaagcuguccugguucaagaagggcagcuccaucgggcagauguucgagaccacgaugcgcggcgccaagcggauggccauccucggcgacaccgccugggacuucgggagccugggcggggucuucaccuccaucggcaaggcccugcaccagguguucggggcgaucuacggcgccgccuucagcggcguguccuggaccaugaagauccucaucggggucgugaucacguggaucggcaugaacagccgcuccaccagccuguccgugagccugguccugguggggguggucacccucuaccugggcgugauggugcaggccgacuccgggugcgucgugagcuggaagaacaaggagcugaagugcggcagcggcaucuucaucaccgacaacgugcacacguggaccgagcaguacaaguuccagcccgagucccccagcaagcucgcguccgccauccagaaggcccacgaggaggggaucugcggcauccggagcgucacccgccuggagaaccugauguggaagcagaucacccccgagcucaaccacauccuguccgagaacgaggugaagcugacgaucaugaccggggacaucaagggcaucaugcaggccgggaagcggagccuccgcccgcagcccaccgagcugaaguacuccuggaagaccuggggcaaggccaagaugcugagcacggagcuccacaaccacaccuuccugaucgacggccccgagaccgcggagugcccgaacaccaaccgggccuggaacucccuggagguggaggacuacggguucggcgucuucacgaccaacaucuggcucaagcugaaggagcgccaggacguguucugcgacagcaagcugauguccgccgccaucaaggacaaccgggccgugcacgcggacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgccggccccgugagccagcacaacuaccgcccgggguaccacacccagacggccggccccuggcaccucgggcggcuggagauggacuucgacuucugcgagggcaccaccgucguggugaccgaggacugcgggaaccgcggccccagccugcggacgaccaccgcguccggcaagcucaucaccgaguggugcugccgcagcugcacgcugcccccgcugcgguaccgcggggaggacggcugcugguacgggauggagauccggccccucaaggagaaggaggagaaccuggucaacucccuggugaccgccggccacgggcagaucgacaacuucagccucggcgugcugggcauggcccuguuccucgaggagaugcugcgcacccgggucgggaccaagcacgccauccugcucguggcgguguccuucgucacgcugaucaccggcaacaugagcuuccgcgaccuggggcgcgugauggugauggucggcgccaccaugaccgacgacaucgggaugggcgugacguaccucgcccugcuggccgccuucaaggugcggcccaccuucgcggccggccuccugcugcgcaagcucaccuccaaggagcugaugaugaccacgaucgggaucguccugcucagccaguccaccauccccgagagcauccuggagcugaccgacgcccucgcccugggcaugauggugcugaagaucguccggaacauggagaaguaccagcucgccgugaccaucauggcgauccugugcgugccgaacgccgucauccugcagaacgccuggaagguguccugcacgacccucgccguggucagcgugagcccccugcugcucaccagcucccagcagaaggccgacuggaucccccuggcgcugaccaucaaggggcucaaccccacggccaucuuccugaccacccugagccgcaccuccaagaagcggagcuggccgcucaacgaggccaucauggccgugggcauggucuccauccuggcgagcagccugcucaagaacgacauccccaugacgggcccccugguggccgggggccugcucaccgugugcuacguccugaccgggcgcuccgccgaccuggagcucgagcgggccgccgacgugcgcugggaggagcaggcggagaucagcggcuccagccccauccuguccaucaccaucagcgaggacggguccaugagcaucaagaacgaggaggaggagcagacgcugaccauccucauccggaccggccugcuggugaucuccggccucuucccggucagcauccccaucaccgccgccgccugguaccugugggaggugaagaagcagcgcgccggggugcugugggacguccccagcccgccgcccgugggcaaggcggagcucgaggacggggccuaccggaucaagcagaagggcauccugggguacagccagaucggcgccggcguguacaaggaggggaccuuccacacgauguggcacgucacccgcggcgccgugcugaugcacaaggggaagcggaucgagcccuccugggccgacgugaagaaggaccucaucagcuacggcgggggcuggaagcuggagggcgaguggaaggagggggaggagguccaggugcuggcgcucgagcccggcaagaacccccgcgccgugcagaccaagcccgggcuguucaagaccaacacgggcaccaucggggccgucucccuggacuucagccccggcaccuccggcagccccaucguggacaagaaggggaagguggucggccucuacgggaacggcguggugacccgguccggcacguacgucagcgccaucgcccagaccgagaaguccaucgaggacaaccccgagaucgaggacgacaucuuccgcaagaagcggcugaccaucauggaccugcaccccggggcgggcaagaccaagcgcuaccugcccgccaucgugcgggaggccaucaagcgcgggcuccggacgcugauccuggccccgacccgcguggucgcggccgagauggaggaggcccuccgcggccugcccauccgguaccagacccccgccauccgcgccgagcacaccgggcgggagaucguggaccugaugugccacgcgacguucaccaugcgccuccugucccccauccgggugccgaacuacaaccugaucaucauggacgaggcccacuucaucgaccccgccagcaucgccgcccgcggcuacaucuccacccgggucgagaugggcgaggcggccgggaucuucaugaccgccacgccgcccggcagccgcgacccguucccccaguccaacgcccccaucauggacgaggagcgggagauccccgagcgcagcuggaacuccgggcacgagugggugaccgacuucaagggcaagaccgugugguucgucccgagcaucaaggccgggaacgacaucgcggccugccuccggaagaacggcaagaaggugauccagcugucccgcaagaccuucgacuucgaguacaucaagacgcggaccaacgacugggacuucguggucaccaccgacaucagcgagaugggcgccaacuucaaggccgagcgcgugaucgacccccggcgcugcaugaagcccgugauccugacggacggggaggagcgggucauccucgcgggccccaugccggugacccacuccagcgccgcccagcgccgggggcgcgugggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaaggucgacgcgaucgacggcgaguaccgccugcgcggggaggcccgcaagaccuucguggaccugaugcggcgcggcgaccuccccgucuggcuggccuaccggguggccgccgaggggaucaacuacgcggaccgccgguggugcuucgacggcgugaagaacaaccagauccuggaggagaacgucgagguggagaucuggacgaaggagggggagcgcaagaagcucaagccgcgguggcuggacgcccgcaucuacagcgacccccuggcccucaaggaguucaaggaguucgccgccggccggaagucccugacccugaaccucaucaccgagaugggccgccugcccaccuucaugacgcagaaggcgaagaacgcccuggacaaccucgccgugcugcacaccgccgaggccgggggccgggccuacaaccacgcccugagcgagcuccccgagacccuggagacccugcuccugcugacgcuccuggccaccgucaccgggggcaucuuccuguuccucauguccggcaaggggaucggcaagaugacccuggggaugugcugcaucaucaccgccagcauccugcucugguacgcgcagauccagccgcacuggaucgccgccuccaucauccuggaguucuuccugaucgugcuccugauccccgagcccgagaagcagcgcacgccccaggacaaccagcugaccuacguggucaucgccauccucaccgugguggccgcgaccauggccaacgagaugggcuuccuggagaagacgaagaaggacuucgggcugggcagcaucaccacccagcagccggagagcaacauccucgacaucgaccugcggcccgccuccgccuggacccuguacgccgucgcgacgaccuucaucacccccaugcuccgccacagcaucgagaacuccagcgugaacgugucccugaccgccaucgccaaccaggccacgguccugaugggccucgggaagggcuggccccugagcaagauggacaucggggugccgcugcucgccaucggcugcuacucccaggugaaccccaucacccugaccgcggcccugcuccugcuggucgcccacuacgccaucaucgggcccggccuccaggcgaaggccacccgggaggcccagaagcgcgccgccgcgggcaucaugaagaaccccacgguggacgggaucaccgugaucgaccuggacccgauccccuacgaccccaaguucgagaagcagcugggccaggucaugcuccuggugcugugcgugacccagguccucaugaugcggaccacgugggcccugugcgaggcccugacccucgccaccgggcccaucagcacccugugggagggcaacccggggcgcuucuggaacacgaccaucgccguguccauggcgaacaucuuccgcggcagcuaccuggccggcgccgggcuccuguucuccaucaugaagaacaccgccaacacccggcgcggcacggggaacaccggcgagacccugggcgagaaguggaagaaccggcucaacgcccuggggaaguccgaguuccagaucuacaagaaguccggcauccaggagguggaccgcacccuggcgaaggaggggaucaagcggggcgagacggaccaccacgccgucagccgcggguccgccaagcuccggugguucguggagcgcaaccuggugacccccgagggcaaggucguggaccugggcugcgggcggggcggguggagcuacuacugcggcgggcucaagaacgugaaggaggucaagggccugaccaagggcgggcccggccacgaggagcccaucccgauguccaccuacggguggaaccuggugcgccuccagagcggcguggacgucuucuucacgccgcccgagaagugcgacacccugcugugcgacaucggggaguccagccccaacccgaccguggaggccggccggacccuccgcgugcugaaccuggucgagaacuggcucaacaacaacacccaguucugcaucaaggugcugaaccccuacaugcccagcgugaucgagaagauggaggcgcugcagcggaaguacggcggggcccugguccgcaacccgcucucccggaacagcacgcacgagauguacuggguguccaacgccagcggcaacaucguguccagcgucaacaugaucucccgcaugcugaucaaccgguucaccaugcgccacaagaaggccaccuacgagcccgacguggaccuggggagcggcacccggaacaucgggaucgaguccgagacgcccaaccucgacaucaucggcaagcgcaucgagaagaucaagcaggagcacgagaccagcuggcacuacgaccaggaccaccccuacaagaccugggccuaccacggcuccuacgagaccaagcagacggggagcgcguccagcauggugaacggcgucgugcgccugcugaccaagccgugggacgugauccccauggucacccagauggccaugaccgacacgacccccuucgggcagcagcggguguucaaggagaaggucgacacccgcacccaggagcccaaggagggcacgaagaagcucaugaagaucaccgccgaguggcuguggaaggagcugggcaagaagaagaccccgcggaugugcacccgcgaggaguucacgcggaaggugcgcuccaacgccgcccucggggcgaucuucaccgacgagaacaaguggaaguccgcccgggaggccguggaggacuccggcuucugggagcuggucgacaaggagcgcaaccugcaccucgaggggaagugcgagaccugcguguacaacaugaugggcaagcgggagaagaagcugggggaguucggcaaggccaagggcagccgcgccaucugguacauguggcugggggcgcgguuccucgaguucgaggcccugggcuuccugaacgaggaccacugguucucccgcgagaacagccucagcgggguggagggcgaggggcugcacaagcugggcuacauccuccgggacgucuccaagaaggagggcggggccauguacgccgacgacaccgcgggcugggacacgcgcaucacccuggaggaccugaagaacgaggagauggugaccaaccacauggagggggagcacaagaagcucgccgaggccaucuucaagcugaccuaccagaacaaggugguccgggugcagcgccccacgccccggggcaccgugauggacaucaucagccgccgggaccagcgcggguccggccaggucgugaccuacggccugaacaccuucacgaacauggaggcccagcucauccggcagauggagggggagggcguguucaagagcauccagcagcugaccgucaccgaggagaucgccgugaagaacuggcuggugcgcgucgggcgcgagcggcucucccgcauggcgaucagcggcgacgacugcguggugaagccccuggacgaccgguucgccuccgcccugaccgcccucaacgacaugggcaagguccgcaaggacauccagcagugggagccgagccggggguggaacgacuggacccaggugcccuucugcucccaccacuuccacgagcugaucaugaaggacggccgcgugcuggucgugcccugccggaaccaggacgagcucaucgggcgcgcccggaucagccagggcgcgggguggucccugcaggagaccgccugccugggcaagagcuacgcccagauguggucccucauguacuuccaccgccgggaccugcgccuggccgccaacgcgaucugcagcgccgugcccucccacugggucccgaccagccggaccaccugguccauccacgccacgcacgaguggaugaccaccgaggacaugcucaccguguggaaccgcguguggauccaggagaaccccuggauggaggacaagacgcccgucgagagcugggaggagauccccuaccugggcaagcgggaggaccaguggugcgggagccugaucggccucaccucccgcgccaccugggccaagaacauccagaccgcgaucaaccaggugcggagccugaucgggaacgaggaguacacggacuacaugccguccaugaagcgcuuccggcgcgaggaggaggaggccggcgugcugugguga

SEQ ID NO: 9674 - RNA, 9876 nt, Artificial Sequence
  derived and/or modified CDS sequence (opt1) from DENV-2__KC762676__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccacccgggguucacgaucauggcggccauccuggccuacaccaucggcaccacccacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaagaccuggggcaaggcgaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuacugcgacagcaagcugauguccgccgccaucaaggacaaccgggcggugcacgccgacaugggguacuggaucgagagcgcccucaacgacaccuggaagaucgagaaggccuccuucaucgaggucaagagcugcuacuggcccaagucccacacccuguggagcaacggcgugcuggaguccgagaugaucauccccaagaacuucgccggccccgugagccagcacaacuaccgcccgggguaccacacccagaccgcgggccccuggcaccucgggcggcuggagauggacuucgacuucugcgagggcacgaccguggucgugaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggucacggccggccacgggcagaucgacaacuucagccucggcgugcugggcauggcccuguuccucgaggagaugcugcgcacccggguggggaccaagcacgcgauccugcucgucgccguguccuucgugacccugaucacgggcaacaugagcuuccgcgaccuggggcgcgucauggugauggugggcgccaccaugaccgacgacaucgggaugggcgucaccuaccucgcccugcuggccgcguucaaggugcggcccacguucgccgccggccuccugcugcgcaagcucaccuccaaggagcugaugaugaccaccaucgggaucgugcugcucagccaguccacgauccccgagaccauccuggagcugaccgacgcccucgcccugggcaugauggcgcugaagaucguccggaacauggagaaguaccagcucgccgugaccaucauggccauccugugcgucccgaacgccgugauccugcagaacgccuggaaggugagcugcacgacccucgcggucguguccgugagcccccugcugcucaccuccagccagcagaaggccgacuggaucccccuggcccugaccaucaaggggcucaaccccacggccaucuuccugaccacccugucccgcaccagcaagaagcgguccuggccgcucaacgaggcgaucauggccgucggcauggugagcauccuggccuccagccugcucaagaacgacauccccaugacgggcccccugguggccgggggccugcucaccgucugcuacgugcugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacgcugaccauccucauccggaccggccugcuggucaucagcggccucuucccgguguccauccccaucaccgccgccgcgugguaccugugggaggugaagaagcagcgcgccgggguccugugggacgugcccagcccgccgcccgugggcaaggccgagcucgaggacggggccuaccggaucaagcagaagggcauccugggguacucccagaucggcgccggcgucuacaaggaggggaccuuccacacgauguggcacgugacccgcggcgcggugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagaccaacacgggcaccaucggggccgugagccuggacuucucccccggcaccagcggcucccccaucguggacaagaaggggaaggucgugggccucuacgggaacggcguggucacccggagcggcacguacguguccgcgaucgcccagaccgagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacgcugauccuggccccgacccgcgucguggccgccgagauggaggaggcccuccgcggccugcccauccgguaccagacccccgcgauccgcgccgagcacaccgggcgggagaucguggaccugaugugccacgccacguucaccaugcgccuccugagccccauccgggucccgaacuacaaccugaucaucauggacgaggcccacuucaccgaccccgccuccaucgcggcccgcggcuacaucagcacccggguggagaugggcgaggccgccgggaucuucaugacggccacgccgcccggcucccgcgacccguucccccagagcaacgcgcccaucauggacgaggagcgggagauccccgagcgcuccuggaacagcgggcacgagugggugaccgacuucaagggcaagaccgucugguucgugccguccaucaaggccgggaacgacaucgccgccugccuccggaagaacggcaagaaggugauccagcugagccgcaagacguucgacuucgaguacaucaagacccggaccaacgacugggacuucgucgugaccacggacaucuccgagaugggcgcgaacuucaaggccgagcgcgugaucgacccccggcgcugcaugaagcccgucauccugaccgacggggaggagcgggugauccucgccggccccaugccggugacccacagcuccgccgcccagcgccgggggcgcgucggccgcaaccccaagaacgagaacgaccaguacaucuacaugggggagccccuggagaacgacgaggacugcgcgcacuggaaggaggccaagaugcugcucgacaacaucaacacccccgagggcaucaucccgagcauguucgagcccgagcgggagaagguggacgccaucgacggcgaguaccgccugcgcggggaggcccgcaagacguucguggaccugaugcggcgcggcgaccuccccgucuggcuggccuaccggguggcggccgaggggaucaacuacgccgaccgccgguggugcuucgacggcgucaagaacaaccagauccuggaggagaacguggagguggagaucuggaccaaggagggggagcgcaagaagcucaagccgcgguggcuggacgcccgcaucuacuccgacccccuggcccucaaggaguucaaggaguucgcggccggccgcaagagccugacccugaaccucaucaccgagaugggccgccugcccacguucaugacccagaaggcccggaacgcccuggacaaccucgcgguccugcacaccgccgaggccgggggccgcgccuacaaccacgcccuguccgagcuccccgagacccuggagacgcugcuccugcugacccuccuggcgaccgugaccgggggcaucuuccuguuccucaugagcggcaaggggaucggcaagaugacccuggggaugugcugcaucaucacggccuccauccugcucugguacgcccagauccagccgcacuggaucgccgccagcaucauccuggaguucuuccugaucgugcuccugauccccgagcccgagaagcagcggacgccccaggacaaccagcugaccuacgucgugaucgcgauccucaccguggucgccgccacgauggccaacgagaugggcuuccuggagaagaccaagaaggacuucgggcugggcuccaucaccacccagcagccggagagcaacauccucgacaucgaccugcgccccgccagcgcguggacgcuguacgccguggccaccaccuucaucacccccaugcuccggcacuccaucgagaacagcuccgugaacgucagccugacggccaucgccaaccaggcgaccgugcugaugggccucgggaagggcuggccccuguccaagauggacaucggggugagccugcucgccaucggcugcuacucccaggucaacccgaucacccugaccgccgcccugcuccugcugguggcgcacuacgccaucaucgggcccggccuccaggccaaggccacgcgcgaggcccagaagcgggcggccgccggcaucaugaagaaccccaccguggacgggaucaccgucaucgaccuggaccccaucccguacgaccccaaguucgagaagcagcugggccaggugaugcuccuggugcugugcgucacccaggugcucaugaugcgcacgaccugggcccugugcgaggcccugacccucgcgaccgggcccaucagcacgcugugggagggcaaccccgggcgcuucuggaacaccaccaucgccguguccauggccaacaucuuccggggcagcuaccuggccggcgccgggcuccuguucuccaucaugaagaacaccgcgaacacgcgccggggcaccgggaacaccggcgagacccugggcgagaaguggaagaaccgccucaacgcccugggcaagagcgaguuccagaucuacaagaaguccggcauccaggaggucgaccggacgcuggccaaggaggggaucaagcgcggcgagaccgaccaccacgccgugagccggggguccgcgaagcuccgcugguucguggagcggaaccuggucaccccggagggcaaggugguggaccugggcugcgggcgcggcggguggagcuacuacugcggcgggcucaagaacgucaaggaggugaagggccugaccaagggcgggcccggccacgaggagcccauccccauguccacguacggguggaaccuggugcggcuccagagcggcgucgacguguucuucaccccgcccgagaagugcgacacccugcugugcgacaucggggaguccagccccaaccccaccguggaggccggccgcacccuccggguccugaaccugguggagaacuggcucaacaacaacacgcaguucugcaucaaggugcugaacccguacaugcccagcgucaucgagaagauggaggcccugcagcgcaaguacggcggggcccuggugcggaacccccucucccgcaacagcacccacgagauguacuggguguccaacgccagcggcaacaucgucuccagcgugaacaugaucucccggaugcugaucaaccgcuucaccaugcggcacaagaaggcgaccuacgagccggacguggaccuggggagcggcacgcgcaacaucgggaucgaguccgagauccccaaccucgacaucaucggcaagcgcaucgagaagaucaagcaggagcacgagaccagcuggcacuacgaccaggaccaccccuaccggaccugggccuaccacggcuccuacgagaccaagcagacggggagcgccuccagcauggucaacggcguggugcgccugcugaccaagcccugggacgucaucccgauggugacccagauggccaugaccgacacgacccccuucgggcagcagcggguguucaaggagaaggucgacacccgcacccaggagcccaaggagggcacgaagaagcucaugaagaucaccgccgaguggcuguggaaggagcugggcaagaagaagacgccccggaugugcacccgcgaggaguucacgcggaaggugcgcuccaacgcggcccucggggccaucuucaccgacgagaacaaguggaaguccgcccgggaggccgucgaggacuccggcuucugggagcugguggacaaggagcgcaaccugcaccucgaggggaagugcgagaccugcguguacaacaugaugggcaagcgggagaagaagcugggggaguucggcaaggcgaagggcagccgcgccaucugguacauguggcugggggcccgguuccucgaguucgaggcccugggcuuccugaacgaggaccacugguucucccgcgagaacagccucagcggggucgagggcgaggggcugcacaagcugggcuacauccuccgggacguguccaagaaggagggcggggcgauguacgccgacgacaccgccggcugggacacgcgcaucacccuggaggaccugaagaacgaggagauggugaccaaccacauggagggggagcacaagaagcucgccgaggccaucuucaagcugaccuaccagaacaaggucgugcgggugcagcgcccgacgccccggggcaccgucauggacaucaucagccgccgggaccagcgcggguccggccagguggugaccuacggccugaacaccuucacgaacauggaggcgcagcucauccgccagauggagggggagggcgucuucaagagcauccagcagcugaccgugaccgaggagaucgccgugaagaacuggcugguccggguggggcgcgagcggcucucccgcauggccaucagcggcgacgacugcguggucaagccccuggacgaccgguucgccaacgcccugaccgcgcucaacgacaugggcaaggugcgcaaggacauccagcagugggagcccucccggggguggaacgacuggacccaggugccguucugcagccaccacuuccacgagcugaucaugaaggacggccgcguccugguggugcccugccggaaccaggacgagcucaucgggcgcgcccggaucucccagggcgccggguggagccugcgcgagaccgccugccugggcaaguccuacgcccagauguggagccucauguacuuccaccggcgcgaccugcggcuggcggccaacgccaucugcuccgccguccccagccacugggugcccaccucccgcaccaccuggagcauccacgccacgcacgaguggaugaccaccgaggacaugcucaccguguggaaccgggucuggauccaggagaacccguggauggaggacaagacgcccguggaguccugggaggagauccccuaccugggcaagcgcgaggaccaguggugcgggagccugaucggccucaccagccgggcgaccugggccaagaacauccagaccgccaucaaccaggugcgcucccugaucgggaacgaggaguacacggacuacaugcccagcaugaagcgcuuccggcgcgaggaggaggaggccggcguccugugguga

SEQ ID NO: 9675 - RNA, 9876 nt, Artificial Sequence
  derived and/or modified CDS sequence (opt1) from DENV-2__KC762662__SS-prME
accgccgggaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccgugacccccuccaugaccaugcgcugcaucgggaucagcaaccgggacuucgucgagggcguguccggcgggagcuggguggacaucguccuggagcacggcuccugcgugaccacgauggcgaagaacaagcccacccucgacuucgagcugaucaagaccgaggccaagcaccccgccacccugcgcaaguacugcaucgaggccaagcucacgaacaccaccaccgccagccggugcccgacgcagggggagcccucccugaacgaggagcaggacaagcgcuucgugugcaagcacagcauggucgaccggggcuggggcaacgggugcggccuguucgggaagggcgggaucgugaccugcgcgauguucacgugcaagaagaacauggagggcaagaucgugcagcccgagaaccucgaguacaccaucgucaucacgccccacuccggcgaggagaacgccguggggaacgacaccggcaagcacgggaaggagaucaaggugaccccgcagagcuccaucaccgaggccgagcugaccggcuacgggacggucaccauggagugcagcccccgcaccggccuggacuucaacgagauggugcuccugcagauggagaacaaggccuggcuggugcaccggcagugguuccucgaccugccccugcccuggcucccgggcgccgacacccagggguccaacuggauccagaaggagacgcuggucaccuucaagaacccccacgcgaagaagcaggacguggucgugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaagguggucaaggagaucgccgagacccagcacggcacgaucgugauccgcgugcaguacgagggggacggcagccccugcaagauccccuucgagaucauggaccuggagaagcggcacguccugggccgccucaucaccgugaacccgaucgugaccgagaaggacucccccgucaacaucgaggcggagccgcccuucggggacagcuacaucaucaucggcguggagccggggcagcugaagcuguccugguucaagaagggcagcuccaucgggcagauguucgagaccacgaugcgcggcgccaagcggauggccauccucggcgacaccgccugggacuucgggagccugggcgggguguucaccuccaucggcaaggcccugcaccaggucuucggggcgaucuacggcgccgccuucagcggcguguccuggaccaugaagauccucaucgggguggucaucacguggaucggcaugaacagccgcuccaccagccuguccgugagccuggugcuggucgggguggugacccucuaccugggcgucauggugcaggccgacuccgggugcguggucagcuggaagaacaaggagcugaagugcggcagcggcaucuucaucaccgacaacgugcacacguggaccgagcaguacaaguuccagcccgagucccccagcaagcucgcguccgccauccagaaggcccacgaggaggggaucugcggcauccggagcgugacccgccuggagaaccugauguggaagcagaucacccccgagcucaaccacauccuguccgagaacgaggucaagcugacgaucaugaccggggacaucaagggcaucaugcaggccgggaagcggagccuccgcccgcagcccaccgagcugaaguacuccuggaagaccuggggcaaggccaagaugcugagcacggagcuccacaaccacaccuuccugaucgacggccccgagaccgcggagugcccgaacgccaaccgggccuggaacucccuggagguggaggacuacggguucggcguguucaccacgaacaucuggcucaagcugaaggagcgccaggacgccuucugcgacagcaagcugauguccgccgcgaucaaggacaaccgggccguccacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcacgaccgugguggucaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggugacggccggccacgggcagaucgacaacuucagccucggcguccugggcauggcgcuguuccucgaggagaugcugcgcacccggguggggaccaagcacgccauccugcucguggccgucuccuucgugacccugaucacgggcaacaugagcuuccgcgaccuggggcgcgugauggucauggugggcgccaccaugaccgacgacaucgggaugggcgugaccuaccucgcccugcuggcggccuucaagguccggcccacguucgccgccggccuccugcugcgcaagcucaccuccaaggagcugaugaugaccaccaucgggaucacgcugcucagccaguccaccauccccgagaccauccuggagcugaccgacgcccucgcgcugggcaugauggugcugaagaucgugcggaacauggagaaguaccagcucgccgucacgaucauggccauccugugcgugccgaacgccgucauccugcagaacgccuggaaggugagcugcaccacccucgcgguggucuccgugagcccccugcugcucaccuccagccagcagaaggccgacuggaucccccuggcccugacgaucaaggggcucaaccccaccgccaucuuccugaccacccugucccgcacgagcaagaagcgguccuggccgcucaacgaggcgaucauggccgugggcauggucagcauccuggccuccagccugcucaagaacgacauccccaugaccggcccccugguggccgggggccugcucaccgugugcuacguccugaccgggcgcagcgccgaccuggagcucgagcgggcggccgacgugcgcugggaggagcaggccgagaucuccggcagcucccccauccugagcaucacgaucuccgaggacgggagcauguccaucaagaacgaggaggaggagcagacccugaccauccucauccggaccggccugcuggugaucagcggccucuucccggucuccauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacucccagaucggcgccggcguguacaaggaggggacguuccacaccauguggcacgucacccgcggcgcggugcugaugcacaaggggaagcggaucgagcccagcugggccgacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagacgagcaccggcaccaucggggccgucucccuggacuucagccccggcaccuccggcagccccaucguggacaagaaggggaagguggucggccucuacgggaacggcguggugacgcgguccggcaccuacgucagcgcgaucgcccagaccgagaaguccaucgaggacaaccccgagaucgaggacgacaucuuccgcaagaagcggcugaccaucauggaccugcaccccggggccggcaagacgaagcgcuaccugcccgccaucgugcgggaggcgaucaagcgcgggcuccggacccugauccuggccccgacccgcguggucgccgccgagauggaggaggcccuccgcggccugcccauccgguaccagacccccgcgauccgcgccgagcacacggggcgggagaucguggaccugaugugccacgccaccuucaccaugcgccuccugucccccauccgggugccgaacuacaaccugaucaucauggacgaggcccacuucaccgaccccgccagcaucgcggcccgcggcuacaucuccacgcgggucgagaugggcgaggccgccgggaucuucaugaccgccacgccgcccggcagccgcgacccguucccccaguccaacgcgcccaucauggacgaggagcgggagauccccgagcgcagcuggaacuccgggcacgagugggugaccgacuucaagggcaagacggugugguucgucccgagcaucaaggccgggaacgacaucgccgccugccuccggaagaacggcaagaaggugauccagcugucccgcaagaccuucgacuucgaguacaucaagacccggaccaacgacugggacuucguggucacgaccgacaucagcgagaugggcgcgaacuucaaggccgagcgcgugaucgacccccggcgcugcaugaagcccgugauccugaccgacggggaggagcgggucauccucgccggccccaugccggugacccacuccagcgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacgcccgagggcaucaucccguccauguucgagcccgagcgggagaaggucgacgccaucgacggcgaguaccgccugcgcggggaggcccgcaagaccuucguggaccugaugcggcgcggcgaccuccccguguggcuggccuaccgggucgcggccgaggggaucaacuacgccgaccgccgguggugcuucgacggcgugaagaacaaccagauccuggaggagaacgucgagguggagaucuggaccaaggagggggagcgcaagaagcucaagccgcgguggcuggacgcccgcaucuacagcgacccccuggcccucaaggaguucaaggaguucgcggccggccggaagucccugacccugaaccucaucacggagaugggccgccugcccaccuucaugacccagaaggcccggaacgcccuggacaaccucgcggugcugcacaccgccgaggccgggggccgcgccuacaaccacgcccugagcgagcuccccgagacgcuggagacccugcuccugcugacccuccuggcgaccgucaccgggggcaucuuccuguuccucauguccggcaagggggugggcaagaugacgcuggggaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugaccuacgucgugaucgcgauccucacgguggucgccgccaccauggccaacgagaugggcuuccuggagaagaccaagaaggacuucgggcugggcagcaucaccacgcagcagccggagagcaacauccucgacaucgaccugcgccccgccuccgcguggacccuguacgccguggccaccaccuucaucacgcccaugcuccggcacagcaucgagaacuccagcgugaacgucucccugaccgccaucgccaaccaggcgaccgugcugaugggccucgggaagggcuggccccugagcaagauggacaucggggugccgcugcucgccaucggcugcuacucccaggucaaccccaucacccugacggccgcccugcuccugcugguggcgcacuacgccaucaucgggcccggccuccaggccaaggccacccgcgaggcccagaagcgggcggccgccggcaucaugaagaaccccaccguggacgggaucaccgucaucgaccuggacccgauccccuacgaccccaaguucgagaagcagcugggccaggugaugcuccuggugcugugcgucacccaggugcucaugaugcgcaccaccugggcccugugcgaggcccugacccucgcgacggggcccaucagcacccugugggagggcaacccggggcgcuucuggaacaccaccaucgccguguccauggccaacaucuuccggggcagcuaccuggccggcgccgggcuccuguucuccaucaugaagaacacggcgaacacccgccggggcaccgggaacaccggcgagacgcugggcgagaaguggaagaaccgccucaacgcccugggcaagagcgaguuccagaucuacaagaaguccggcauccaggaggucgaccggacccuggccaaggaggggaucaagcgcggcgagaccgaccaccacgccgugagccggggguccgcgaagcuccgcugguucguggagcggaaccuggucacccccgagggcaaggugguggaccugggcugcgggcgcggcggguggagcuacuacugcggcgggcucaagaacgucaaggaggugaagggccugacgaagggcgggcccggccacgaggagcccaucccgauguccaccuacggguggaaccuggugcggcuccagagcggcgucgacguguucuucacgccgcccgagaagugcgacacccugcugugcgacaucggggaguccagccccaacccgaccguggaggccggccgcacgcuccggguccugaaccugguggagaacuggcucaacaacaacacccaguucugcaucaaggugcugaaccccuacaugcccagcgucaucgagaagauggaggcccugcagcgcaaguacggcggggcccuggugcggaacccgcucucccgcaacagcacccacgagauguacuggguguccaacgccagcggcaacaucgucuccagcgugaacaugaucucccggaugcugaucaaccgcuucaccaugcggcacaagaaggcgacguacgagcccgacguggaccuggggagcggcacccgcaacaucgggaucgaguccgagacccccaaccucgacaucaucggcaagcgcaucgagaagaucaagcaggagcacgagaccagcuggcacuacgaccaggaccaccccuacaagacgugggccuaccacggcuccuacgagaccaagcagaccgggagcgccuccagcauggucaacggcguggugcggcugcugaccaagccgugggacgucauccccauggugacgcagauggccaugaccgacaccacccccuucgggcagcagcgcguguucaaggagaaggucgacacgcggacccaggagcccaaggagggcaccaagaagcucaugaagaucaccgccgaguggcuguggaaggagcugggcaagaagaagacgccgcgcaugugcacccgggaggaguucacccgcaaggugcgguccaacgcggcccucggggccaucuucaccgacgagaacaaguggaaguccgcccgcgaggccgucgaggacuccggcuucugggagcugguggacaaggagcggaaccugcaccucgaggggaagugcgagacgugcguguacaacaugaugggcaagcgcgagaagaagcugggggaguucggcaaggcgaagggcagccgggccaucugguacauguggcugggggcccgcuuccucgaguucgaggcccugggcuuccugaacgaggaccacugguucucccgggagaacagccucagcggggucgagggcgaggggcugcacaagcugggcuacauccuccgcgacguguccaagaaggagggcggggcgauguacgccgacgacaccgccggcugggacacccggaucacccuggaggaccugaagaacgaggagauggugacgaaccacauggagggggagcacaagaagcucgccgaggccaucuucaagcugaccuaccagaacaaggucgugcgcgugcagcggcccacgccccggggcaccgucauggacaucaucagccggcgcgaccagcggggguccggccagguggugacguacggccugaacaccuucaccaacauggaggcgcagcucauccgccagauggagggggagggcgucuucaagagcauccagcagcugaccgugacggaggagaucgccgugaagaacuggcuggucaccguggggcgcgagcggcucucccgcauggccaucagcggcgacgacugcguggucaagccccuggacgaccgguucgccuccgcccugaccgcgcucaacgacaugggcaaggugcgcaaggacauccagcagugggagccgagccggggguggaacgacuggacccaggugcccuucugcucccaccacuuccacgagcugaucaugaaggacggccgcguccugguggugcccugccggaaccaggacgagcucaucgggcgcgcccggaucagccagggcgccggguggucccugcgcgagaccgccugccugggcaagagcuacgcccagauguggucccucauguacuuccaccggcgcgaccugcggcuggcggccaacgccaucugcagcgccguccccucccacugggugccgacgagccgcaccaccugguccauccacgccacccacgaguggaugacgaccgaggacaugcucaccguguggaaccgggucuggauccaggagaaccccuggauggaggacaagacccccguggagagcugggaggagauccccuaccugggcaagcgcgaggaccaguggugcgggagccugaucggccucacgucccgggcgaccugggccaagaacauccagaccgccaucaaccaggugcgcagccugaucgggaacgaggaguacaccgacuacaugccguccaugaagcgguuccgccgcgaggaggaggaggccggcguccugugguga

SEQ ID NO: 9676 - RNA, 9876 nt, Artificial Sequence
  derived and/or modified CDS sequence (opt1) from DENV-2__KC762661__SS-prME
accgccgggaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccaccuacuuccagcgggugcugaucuucauccuccugacggccgugacccccuccaugaccaugcgcugcaucgggaucagcaaccgggacuucgucgagggcguguccggcgggagcuggguggacaucguccuggagcacggcuccugcgugaccacgauggcgaagaacaagcccacccucgacuucgagcugaucaagaccgaggccaagcaccccgccacccugcgcaaguacugcaucgaggccaagcucacgaacaccaccaccgccagccggugcccgacgcagggggagcccucccugaacgaggagcaggacaagcgcuucgugugcaagcacagcauggucgaccggggcuggggcaacgggugcggccuguucgggaagggcgggaucgugaccugcgcgauguucacgugcaagaagaacauggagggcaagaucgugcagcccgagaaccucgaguacaccaucgucaucacgccccacuccggcgaggagaacgccguggggaacgacaccggcaagcacgggaaggagaucaaggugaccccgcagagcuccaucaccgaggccgagcugaccggcuacgggacggucaccauggagugcagcccccgcaccggccuggacuucaacgagauggugcuccugcagauggagaacaaggccuggcuggugcaccggcagugguuccucgaccugccccugcccuggcucccgggcgccgacacccagggguccaacuggauccagaaggagacgcuggucaccuucaagaacccccacgcgaagaagcaggacguggucgugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaagguggucaaggagaucgccgagacccagcacggcacgaucgugauccgcgugcaguacgagggggacggcagccccugcaagauccccuucgagaucauggaccuggagaagcggcacguccugggccgccucaucaccgugaacccgaucgugaccgagaaggacucccccgucaacaucgaggcggagccgcccuucggggacagcuacaucaucaucggcguggagccggggcagcugaagcuguccugguucaagaagggcagcuccaucgggcagauguucgagaccacgaugcgcggcgccaagcggauggccauccucggcgacaccgccugggacuucgggagccugggcgggguguucaccuccaucggcaaggcccugcaccaggucuucggggcgaucuacggcgccgccuucagcggcguguccuggaccaugaagauccucaucgggguggucaucacguggaucggcaugaacagccgcuccaccagccuguccgugagccuggugcuggucgggguggugacccucuaccugggcgucauggugcaggccgacuccgggugcguggucagcuggaagaacaaggagcugaagugcggcagcggcaucuucaucaccgacaacgugcacacguggaccgagcaguacaaguuccagcccgagucccccagcaagcucgcguccgccauccagaaggcccacgaggaggggaucugcggcauccggagcgugacccgccuggagaaccugauguggaagcagaucacccccgagcucaaccacauccuguccgagaacgaggucaagcugacgaucaugaccggggacaucaagggcaucaugcaggccgggaagcggagccuccgcccgcagcccaccgagcugaaguacuccuggaagaccuggggcaaggccaagaugcugagcacggagcuccacaaccacaccuuccugaucgacggccccgagaccgcggagugcccgaacgccaaccgggccuggaacucccuggagguggaggacuacggguucggcguguucaccacgaacaucuggcucaagcugaaggagcgccaggacgccuucugcgacagcaagcugauguccgccgcgaucaaggacaaccgggccguccacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccagacccagaccgccggccccuggcaccucgggcggcuggagauggacuucgacuucugcgagggcacgaccgugguggucaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggugacggccggccacgggcagaucgacaacuucagccucggcguccugggcauggcgcuguuccucgaggagaugcugcgcacccggguggggaccaagcacgccauccugcucguggccgucuccuucgugacccugaucacgggcaacaugagcuuccgcgaccuggggcgcgugauggucauggugggcgccaccaugaccgacgacaucgggaugggcgugaccuaccucgcccugcuggcggccuucaagguccggcccacguucgccgccggccuccugcugcgcaagcucaccuccaaggagcugaugaugaccaccaucgggaucacgcugcucagccaguccaccauccccgagaccauccuggagcugaccgacgcccucgcgcugggcaugauggugcugaagaucgugcggaacauggagaaguaccagcucgccgucacgaucauggccauccugugcgugccgaacgccgucauccugcagaacgccuggaaggugagcugcaccacccucgcgguggucuccgugagcccccugcugcucaccuccagccagcagaaggccgacuggaucccccuggcccugacgaucaaggggcucaaccccaccgccaucuuccugaccacccugucccgcacgagcaagaagcgguccuggccgcucaacgaggcgaucauggccgugggcauggucagcauccuggccuccagccugcucaagaacgacauccccaugaccggcccccugguggccgggggccugcucaccgugugcuacguccugaccgggcgcagcgccgaccuggagcucgagcgggcggccgacgugcgcugggaggagcaggccgagaucuccggcagcucccccauccugagcaucacgaucuccgaggacgggagcauguccaucaagaacgaggaggaggagcagacccugaccauccucauccggaccggccugcuggugaucagcggccucuucccggucuccauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacucccagaucggcgccggcguguacaaggaggggacguuccacaccauguggcacgucacccgcggcgcggugcugaugcacaaggggaagcggaucgagcccagcugggccgacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagacgagcaccggcaccaucggggccgucucccuggacuucagccccggcaccuccggcagccccaucguggacaagaaggggaagguggucggccucuacgggaacggcguggugacgcgguccggcaccuacgucagcgcgaucgcccagaccgagaaguccaucgaggacaaccccgagaucgaggacgacaucuuccgcaagaagcggcugaccaucauggaccugcaccccggggccggcaagacgaagcgcuaccugcccgccaucgugcgggaggcgaucaagcgcgggcuccggacccugauccuggccccgacccgcguggucgccgccgagauggaggaggcccuccgcggccugcccauccgguaccagacccccgcgauccgcgccgagcacacggggcgggagaucguggaccugaugugccacgccaccuucaccaugcgccuccugucccccauccgggugccgaacuacaaccugaucaucauggacgaggcccacuucaccgaccccgccagcaucgcggcccgcggcuacaucuccacgcgggucgagaugggcgaggccgccgggaucuucaugaccgccacgccgcccggcagccgcgacccguucccccaguccaacgcgcccaucauggacgaggagcgggagauccccgagcgcagcuggaacuccgggcacgagugggugaccgacuucaagggcaagacggugugguucgucccgagcaucaaggccgggaacgacaucgccgccugccuccggaagaacggcaagaaggugauccagcugucccgcaagaccuucgacuucgaguacaucaagacccggaccaacgacugggacuucguggucacgaccgacaucagcgagaugggcgcgaacuucaaggccgagcgcgugaucgacccccggcgcugcaugaagcccgugauccugaccgacggggaggagcgggucauccucgccggccccaugccggugacccacuccagcgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacgcccgagggcaucaucccguccauguucgagcccgagcgggagaaggucgacgccaucgacggcgaguaccgccugcgcggggaggcccgcaagaccuucguggaccugaugcggcgcggcgaccuccccguguggcuggccuaccgggucgcggccgaggggaucaacuacgccgaccgccgguggugcuucgacggcgugaagaacaaccagauccuggaggagaacgucgagguggagaucuggaccaaggagggggagcgcaagaagcucaagccgcgguggcuggacgcccgcaucuacagcgacccccuggcccucaaggaguucaaggaguucgcggccggccggaagucccugacccugaaccucaucacggagaugggccgccugcccaccuucaugacccagaaggcccggaacgcccuggacaaccucgcggugcugcacaccgccgaggccgggggccgcgccuacaaccacgcccugagcgagcuccccgagacgcuggagacccugcuccugcugacccuccuggcgaccgucaccgggggcaucuuccuguuccucauguccggcaaggggaucggcaagaugacgcuggggaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugaccuacguggucaucgcgauccucacggugguggccgccaccauggccaacgagaugggcuuccuggagaagaccaagaaggacuucgggcugggcagcaucaccacgcagcagccggagagcaacauccucgacaucgaccugcgccccgccuccgcguggacccuguacgccgucgccaccaccuucaucacgcccaugcuccggcacagcaucgagaacuccagcgugaacgugucccugaccgccaucgccaaccaggcgaccguccugaugggccucgggaagggcuggccccugagcaagauggacaucggggugccgcugcucgccaucggcugcuacucccaggugaaccccaucacccugacggccgcccugcuccugcuggucgcgcacuacgccaucaucgggcccggccuccaggccaaggccacccgcgaggcccagaagcgggcggccgccggcaucaugaagaaccccaccguggacgggaucaccgugaucgaccuggacccgauccccuacgaccccaaguucgagaagcagcugggccaggucaugcuccuggugcugugcgugacgcagguccucaugaugcgcaccaccugggcccugugcgaggcccugacccucgcgacggggcccaucagcacccugugggagggcaacccggggcgcuucuggaacaccaccaucgccguguccauggccaacaucuuccggggcagcuaccuggccggcgccgggcuccuguucuccaucaugaagaacacggcgaacacccgccggggcaccgggaacaccggcgagacgcugggcgagaaguggaagaaccgccucaacgcccugggcaagagcgaguuccagaucuacaagaaguccggcauccaggagguggaccggacccuggccaaggaggggaucaagcgcggcgagaccgaccaccacgccgucagccggggguccgcgaagcuccgcugguucguggagcggaaccuggugacccccgagggcaaggucguggaccugggcugcgggcgcggcggguggagcuacuacugcggcgggcucaagaacgugaaggaggucaagggccugacgaagggcgggcccggccacgaggagcccaucccgauguccaccuacggguggaaccuggugcggcuccagagcggcguggacgucuucuucacgccgcccgagaagugcgacacccugcugugcgacaucggggaguccagccccaacccgaccguggaggccggccgcacgcuccgggugcugaaccuggucgagaacuggcucaacaacaacacccaguucugcaucaaggugcugaaccccuacaugcccagcgugaucgagaagauggaggcccugcagcgcaaguacggcggggcccugguccggaacccgcucucccgcaacagcacccacgagauguacuggguguccaacgccagcggcaacaucguguccagcgucaacaugaucucccggaugcugaucaaccgcuucaccaugcggcacaagaaggcgacguacgagcccgacguggaccuggggagcggcacccgcaacaucgggaucgaguccgagacccccaaccucgacaucaucggcaagcgcaucgagaagaucaagcaggagcacgagaccagcuggcacuacgaccaggaccaccccuacaagacgugggccuaccacggcuccuacgagaccaagcagaccgggagcgccuccagcauggugaacggcgucgugcggcugcugaccaagccgugggacgugauccccauggucacgcagauggccaugaccgacaccacccccuucgggcagcagcgcguguucaaggagaagguggacacgcggacccaggagcccaaggagggcaccaagaagcucaugaagaucaccgccgaguggcuguggaaggagcugggcaagaagaagacgccgcgcaugugcacccgggaggaguucacccgcaagguccgguccaacgcggcccucggggccaucuucaccgacgagaacaaguggaaguccgcccgcgaggccguggaggacuccggcuucugggagcuggucgacaaggagcggaaccugcaccucgaggggaagugcgagacgugcguguacaacaugaugggcaagcgcgagaagaagcugggggaguucggcaaggcgaagggcagccgggccaucugguacauguggcugggggcccgcuuccucgaguucgaggcccugggcuuccugaacgaggaccacugguucucccgggagaacagccucagcgggguggagggcgaggggcugcacaagcugggcuacauccuccgcgacgucuccaagaaggagggcggggcgauguacgccgacgacaccgccggcugggacacccggaucacccuggaggaccugaagaacgaggagauggugacgaaccacauggagggggagcacaagaagcucgccgaggccaucuucaagcugaccuaccagaacaaggugguccgcgugcagcggcccacgccccggggcaccgugauggacaucaucagccggcgcgaccagcggggguccggccaggucgugacguacggccugaacaccuucaccaacauggaggcgcagcucauccgccagauggagggggagggcguguucaagagcauccagcagcugaccgucacggaggagaucgccgugaagaacuggcuggugcgcgucgggcgggagcgccucucccggauggccaucagcggcgacgacugcguggugaagccccuggacgaccgcuucgccuccgcccugaccgcgcucaacgacaugggcaagguccggaaggacauccagcagugggagccgagccgcggguggaacgacuggacccaggugcccuucugcucccaccacuuccacgagcugaucaugaaggacggccgggugcuggucgugcccugccgcaaccaggacgagcucaucgggcgggcccgcaucagccagggcgccggguggucccugcgggagaccgccugccugggcaagagcuacgcccagauguggucccucauguacuuccaccgccgggaccugcgccuggcggccaacgccaucugcagcgccgugcccucccacugggucccgaccagccggacgaccugguccauccacgccacccacgaguggaugaccacggaggacaugcucaccguguggaaccgcguguggauccaggagaaccccuggauggaggacaagacccccgucgagagcugggaggagauccccuaccugggcaagcgggaggaccaguggugcgggagccugaucggccucaccucccgcgcgacgugggccaagaacauccagaccgccaucaaccaggugcggagccugaucgggaacgaggaguacaccgacuacaugccguccaugaagcgcuuccgccgggaggaggaggaggccggcgugcugugguga

SEQ ID NO: 9677 - RNA, 9876 nt, Artificial Sequence
  derived and/or modified CDS sequence (opt1) from DENV-2__KC762655__SS-prME
accgcgggcaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccgugacccccuccaugaccaugcgcugcaucgggaucagcaaccgggacuucgucgagggcguguccggcgggagcuggguggacaucguccuggagcacggcuccugcgugaccacgauggcgaagaacaagcccacccucgacuucgagcugaucaagaccgaggccaagcaccccgccacccugcgcaaguacugcaucgaggccaagcucacgaacaccaccaccgccagccggugcccgacgcagggggagcccucccugaacgaggagcaggacaagcgcuucgugugcaagcacagcauggucgaccggggcuggggcaacgggugcggccuguucgggaagggcgggaucgugaccugcgcgauguucacgugcaagaagaacauggagggcaaggugguccagcccgagaaccucgaguacaccaucgugaucacgccccacuccggcgaggagaacgccguggggaacgacaccggcaagcacgggaaggagaucaaggucaccccgcagagcuccaucaccgaggccgagcugaccggcuacgggacggugaccauggagugcagcccccgcaccggccuggacuucaacgagauggugcuccugcagauggagaacaaggccuggcugguccaccggcagugguuccucgaccugccccugcccuggcucccgggcgccgacacccagggguccaacuggauccagaaggagacgcuggugaccuucaagaacccccacgcgaagaagcaggacgucguggugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaaggucgugaaggagaucgccgagacccagcacggcacgaucgugauccgcguccaguacgagggggacggcagccccugcaagauccccuucgagaucauggaccuggagaagcggcacgugcugggccgccucaucaccgugaacccgaucgucaccgagaaggacucccccgugaacaucgaggcggagccgcccuucggggacagcuacaucaucaucggcguggagccggggcagcugaagcuguccugguucaagaagggcagcuccaucgggcagauguucgagaccacgaugcgcggcgccaagcggauggccauccucggcgacaccgccugggacuucgggagccugggcggggucuucaccuccaucggcaaggcccugcaccagguguucggggcgguguacggcgccgccuucagcggcgucuccuggaccaugaagauccucaucgggguggugaucacguggaucggcaugaacagccgcuccaccagccuguccgucagccuggugcuggugggggucgugacccucuaccugggcgugaugguccaggccgacuccgggugcguggugagcuggaagaacaaggagcugaagugcggcagcggcaucuucaucaccgacaacguccacacguggaccgagcaguacaaguuccagcccgagucccccagcaagcucgcguccgccauccagaaggcccacgaggaggggaucugcggcauccggagcgugacccgccuggagaaccugauguggaagcagaucacccccgagcucaaccacauccuguccgagaacgaggugaagcugacgaucaugaccggggacaucaagggcaucaugcaggccgggaagcggagccuccgcccgcagcccaccgagcugaaguacuccuggaaggccuggggcaaggcgaagaugcugagcaccgagcuccacaaccacacguuccugaucgacggccccgagaccgccgagugcccgaacaccaaccgggccuggaacucccuggaggucgaggacuacggguucggcguguucaccacgaacaucuggcucaagcugaaggagcgccaggacguguucugcgacagcaagcugauguccgccgccaucaaggacaacaaggcgguccacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgccggccccgugagccagcacaacuaccggccgggguaccacacccagaccgcgggccccuggcaccucgggcgccuggagauggacuucgacuucugcgagggcacgaccgugguggucaccgaggacugcgggaaccggggccccagccugcgcaccacgaccgccuccggcaagcucaucaccgaguggugcugccggagcugcacccugcccccgcugcgcuaccgcggggaggacggcugcugguacgggauggagauccgcccccucaaggagaaggaggagaaccuggugaacucccuggugacggccggccacgggcagaucgacaacuucagccucggcguccugggcauggcccuguuccucgaggagaugcugcggacccgcguggggaccaagcacgcgauccugcucguggccgucuccuucgugacccugaucacgggcaacaugagcuuccgggaccuggggcgcgugauggucauggugggcgccaccaugaccgacgacaucgggaugggcgugaccuaccucgcccugcuggccgcguucaagguccgccccacguucgccgccggccuccugcugcggaagcucaccuccaaggagcugaugaugaccaccaucgggaucgugcugcucagccaguccacgauccccgagaccauccuggagcugaccgacgcccucgcccugggcaugaugguccugaagaucgugcgcaacauggagaaguaccagcucgcggugaccaucauggccauccugugcgucccgaacgccgugauccugcagaacgccuggaaggugagcugcacgacccucgccgucguguccgugagcccccugcugcucaccuccagccagcagaaggcggacuggaucccccuggcccugaccaucaaggggcucaaccccacggccaucuuccugaccacccugucccggaccagcaagaagcgcuccuggccgcucaacgaggccaucauggcggucggcauggugagcauccuggccuccagccugcucaagaacgacauccccaugacgggcccccugguggccgggggccugcucaccgucugcuacgugcugaccgggcggagcgccgaccuggagcucgagcgcgccgcggacgugcggugggaggagcaggccgagaucuccggcagcucccccauccugagcaucaccaucuccgaggacgggagcauguccaucaagaacgaggaggaggagcagacgcugaccauccucauccgcaccggccugcuggucaucagcggccucuucccgguguccauccccaucaccgccaccgccugguaccugugggaggugaagaagcagcgggccgggguccugugggacgugcccagcccgccgcccgugggcaaggcggagcucgaggacggggccuaccgcaucaagcagaagggcauccugggguacucccagaucggcgccggcgucuacaaggaggggacguuccacaccauguggcacgugacccggggcgccgugcugaugcacaaggggaagcgcaucgagcccagcugggccgacgucaagaaggaccucaucuccuacggcgggggcuggaagcuggagggcgaguggaaggagggggaggagguccaggugcuggcgcucgagcccggcaagaacccccgggccguccagaccaagcccgggcuguucaagacgaacaccggcaccaucggggccgugagccuggacuucucccccggcaccagcggcucccccaucguggacaagaaggggaaggucgugggccucuacgggaacggcguggucacgcgcagcggcaccuacguguccgccaucgcccagaccgagaaguccaucgaggacaaccccgagaucgaggacgacaucuuccggaagaagcgccugaccaucauggaccugcaccccggggcgggcaagacgaagcgguaccugcccgccaucgugcgcgaggccaucaagcgggggcuccgcacccugauccuggccccgacccgggucguggcggccgagauggaggaggcccuccgcggccugcccauccgcuaccagacccccgccauccgggccgagcacacggggcgcgagaucguggaccugaugugccacgcgaccuucaccaugcggcuccugagccccauccgcgucccgaacuacaaccugaucaucauggacgaggcccacuucaccgaccccgccuccaucgccgcccggggcuacaucagcacgcgcguggagaugggcgaggcggccgggaucuucaugaccgccacgccgcccggcucccgggacccguucccccagagcaacgcccccaucauggacgaggagcgcgagauccccgagcgguccuggaacagcgggcacgagugggugaccgacuucaagggcaagacggucugguucgugccguccaucaaggccgggaacgacaucgcggccugccuccgcaagaacggcaagaaggugauccagcugagccggaagaccuucgacuucgaguacaucaagacccgcaccaacgacugggacuucgucgugacgaccgacaucuccgagaugggcgccaacuucaaggccgagcgggugaucgacccccgccggugcaugaagcccgucauccugaccgacggggaggagcgcgugauccucgcgggccccaugccggugacccacagcuccgccgcccagcggcgcgggcgggucggccgcaaccccaagaacgagaacgaccaguacaucuacaugggggagccccuggagaacgacgaggacugcgcccacuggaaggaggccaagaugcugcucgacaacaucaacacgcccgagggcaucaucccgagcauguucgagcccgagcgcgagaagguggacgcgaucgacggcgaguaccggcugcgcggggaggcccggaagaccuucgucgaccugaugcgccggggcgaccuccccguguggcuggccuaccgcguggccgccgaggggaucaacuacgcggaccggcgcuggugcuucgacggcgucaagaacaaccagauccuggaggagaacguggagguggagaucuggaccaaggagggggagcggaagaagcucaagccgcgcuggcuggacgcccggaucuacuccgacccccuggcccucaaggaguucaaggaguucgccgccggccgcaagagccugacccugaaccucaucacggagaugggccggcugcccaccuucaugacccagaaggcgcgcaacgcccuggacaaccucgccguccugcacaccgccgaggccgggggccgggccuacaaccacgcccuguccgagcuccccgagacgcuggagacccugcuccugcugacccuccuggccaccgugaccgggggcaucuuccuguuccucaugagcggcaaggggaucggcaagaugacgcuggggaugugcugcaucaucaccgccuccauccugcucugguacgcgcagauccagccgcacuggaucgccgccagcaucauccuggaguucuuccugaucgugcuccugauccccgagcccgagaagcagcgcacgccccaggacaaccagcugaccuacgucgugaucgccauccucacgguggucgccgcgaccauggccaacgagaugggcuuccuggagaagaccaagaaggacuucgggcugggcuccaucgccacccagcagccggagagcaacauccucgacaucgaccugcggcccgccagcgccuggacgcuguacgcgguggccaccaccuucaucacccccaugcuccgccacuccaucgagaacagcuccgugaacgucagccugacggccaucgccaaccaggccaccgugcugaugggccucgggaagggcuggccccuguccaagauggacaucggggugccgcugcucgcgaucggcugcuacagccaggucaaccccaucacccugaccgccgcccugcuccugcugguggcccacuacgcgaucaucgggcccggccuccaggccaaggccacgcgggaggcccagaagcgcgccgcggccggcaucaugaagaaccccaccguggacgggaucaccgucaucgaccuggacccgauccccuacgaccccaaguucgagaagcagcugggccaggugaugcuccuggugcugugcgucacccaggugcucaugaugcggacgaccugggcccugugcgaggcccugacccucgccaccgggcccaucuccacgcugugggagggcaacccggggcgcuucuggaacaccaccaucgcggugagcauggccaacaucuuccgcggcuccuaccuggccggcgccgggcuccuguucagcaucaugaagaacaccgccaacacgcggcgcggcaccgggaacaccggcgagacccugggcgagaaguggaagaaccggcucaacgcgcuggggaaguccgaguuccagaucuacaagaaguccggcauccaggaggucgaccgcacgcuggccaaggaggggaucaagcggggcgagaccgaccaccacgccgugucccgcgggagcgccaagcuccggugguucguggagcgcaaccuggucacccccgagggcaaggugguggaccugggcugcgggcggggcgggugguccuacuacugcggcgggcucaagaacgucaaggaggugaagggccugaccaagggcgggcccggccacgaggagcccaucccgaugagcacguacggguggaaccuggugcgccuccaguccggcgucgacguguucuucacgccgcccgagaagugcgacacccugcugugcgacaucggggagagcucccccaacccgaccguggaggcgggccggacccuccgcguccugaaccugguggagaacuggcucaacaacaacacgcaguucugcaucaaggugcugaaccccuacaugcccagcgucaucgagaagauggaggcccugcagcggaaguacggcggggcccuggugcgcaacccgcucagccggaacuccacccacgagauguacugggugagcaacgccuccggcaacaucgucagcuccgugaacaugaucagccgcaugcugaucaaccgguucaccaugcgccacaagaaggccaccuacgagcccgacguggaccugggguccggcacgcggaacaucgggaucgagagcgagacccccaaccucgacaucaucggcaagcgcaucgagaagaucaagcaggagcacgagaccuccuggcacuacgaccaggaccaccccuacaagaccugggcguaccacggcagcuacgagacgaagcagaccggguccgccagcuccauggucaacggcguggugcgccugcugaccaagccgugggacgucauccccauggugacccagauggccaugacggacaccacccccuucgggcagcagcgggucuucaaggagaagguggacacccgcacgcaggagcccaaggagggcaccaagaagcucaugaagaucaccgccgaguggcuguggaaggagcugggcaagaagaagaccccgcggaugugcacgcgcgaggaguucacccggaaggugcgcagcaacgccgcgcucggggccaucuucaccgacgagaacaaguggaaguccgcccgggaggccgucgaggacagcggcuucugggagcugguggacaaggagcgcucccugcaccucgaggggaagugcgagaccugcguguacaacaugaugggcaagcgggagaagaagcugggggaguucggcaaggccaagggcagccgcgcgaucugguacauguggcugggggcccgguuccucgaguucgaggcccugggcuuccugaacgaggaccacugguucucccgcgagaacagccucagcggggucgagggcgaggggcugcacaagcugggcuacauccuccgggacguguccaagaaggagggcggggccauguacgcggacgacacggccggcugggacacccgcaucacccuggaggaccugaagaacgaggagauggugaccaaccacauggagggggagcacaagaagcucgccgaggccaucuucaagcugacguaccagaacaaggucgugcgggugcagcgccccacgccccggggcaucgucauggacaucaucagccgccgggaccagcgcggguccggccagguggugaccuacggccugaacaccuucacgaacauggaggcccagcucauccggcagauggagggggagggcgucuucaagagcauccagcagcugaccgugaccgaggagaucgcggugaagaacuggcuggcccgcgucgggcgcgagcggcucucccgcauggccaucagcggcgacgacugcguggugaagccccuggacgaccgguucgccuccgcccugaccgcgcucaacgacaugggcaagguccgcaaggacauccagcagugggagccgagccggggguggaacgacuggacccaggugcccuucugcucccaccacuuccacgagcugaucaugaaggacggccgcgugcuggucgugcccugccggaaccaggacgagcucaucgggcgcgcccggaucagccagggcgccggguggucccugcgcgagaccgccugccugggcaagagcuacgcccagauguggucccucauguacuuccaccggcgcgaccugcggcuggcggccaacgccaucugcagcgccgugcccucccacugggucccgaccagccgcaccaccugguccauccacgccacgcacgaguggaugaccaccgaggacaugcucaccguguggaaccggguguggauccaggagaaccccuggauggaggacaagacgcccgucgagagcugggaggagauccccuaccugggcaagcgcgaggaccaguggugcgggagccugaucggccucaccucccgggcgaccugggcccgcaacauccagaccgccaucaaccaggugcggagccugaucgggaacgaggaguacacggacuacaugccguccaugaagcgcuuccgccgggaggaggaggaggccggcgugcugugguga

SEQ ID NO: 9678 - RNA, 9876 nt, Artificial Sequence
  derived and/or modified CDS sequence (opt1) from DENV-2__KC762656__SS-prME
accgccggcaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacgcgcgccgagaccuggauguccagcgagggcgccuggaagcacgcgcagcggaucgagaccuggguccuccgccaccccggguucaccaucauggccgccauccuggccuacacgaucggcaccaccuacuuccagcgggugcugaucuucauccuccugaccgcggugacgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucgggaccaucuacggcgccgccuucagcggcguguccuggaccaugaagauccucaucggggucgugaucacguggaucggcaugaacagccgcuccaccagccuguccgugagccugguccugguggggguggucacccucuaccugggcgugauggugcaggccgacuccgggugcgucgugagcuggaagaacaaggagcugaagugcggcagcggcaucuucaucaccgacaacgugcacacguggaccgagcaguacaaguuccagcccgagucccccagcaagcucgcguccgccauccagaaggcccacgaggaggggaucugcggcauccggagcgucacccgccuggagaaccugauguggaagcagaucacccccgagcucaaccacauccuguccgagaacgaggugaagcugacgaucaugaccggggacaucaagggcaucaugcaggccgggaagcggagccuccgcccgcagcccaccgagcugaaguacuccuggaaggccuggggcaaggcgaagaugcugagcaccgagcuccacaaccacacguuccugaucgacggccccgagaccgccgagugcccgaacaccaaccgggccuggaacucccuggagguggaggacuacggguucggcgucuucaccacgaacaucuggcucaagcugaaggagcgccaggacguguucugcgacagcaagcugauguccgccgccaucaaggacaaccgggcggugcacgccgacaugggguacuggaucgagagcgcccucaacgacaccuggaagaucgagaaggccuccuucaucgaggucaagagcugccaguggcccaagucccacacccuguggagcaacggcgugcuggaguccgagaugaucauccccaagaacuucgccggccccgugagccagcacaacuaccgcccgggguaccacacccagaccgcgggccccuggcaccucgggcggcuggagauggacuucgacuucugcgagggcacgaccgucguggugaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggucaacucccuggugacggccggccacgggcagaucgacaacuucagccucggcgugcugggcauggcccuguuccucgaggagaugcugcgcacccgggucgggaccaagcacgcgauccugcucguggccguguccuucgucacccugaucacgggcaacaugagcuuccgcgaccuggggcgcgugauggugauggucggcgccaccaugaccgacgacaucgggaugggcgugaccuaccucgcccugcuggccgcguucaaggugcggcccacguucgccgccggccuccugcugcgcaagcucaccuccaaggagcugaugaugaccaccaucgggaucguccugcucagccaguccacgauccccgagaccauccuggagcugaccgacgcccucgcccugggcaugauggugcugaagaucguccggaacauggagaaguaccagcucgcggugaccaucauggccauccugugcgugccgaacgccgucauccugcagaacgccuggaaggugagcugcacgacccucgccguggucuccgugagcccccugcugcucaccuccagccagcagaaggcggacuggaucccccuggcccugaccaucaaggggcucaaccccacggccaucuuccugaccacccugucccgcaccagcaagaagcgguccuggccgcucaacgaggccaucauggcggugggcauggucagcauccuggccuccagccugcucaagaacgacauccccaugacgggcccccugguggccgggggccugcucaccgugugcuacguccugaccgggcgcagcgccgaccuggagcucgagcgggccgcggacgugcgcugggaggagcaggccgagaucuccggcagcucccccauccugagcaucaccaucuccgaggacgggagcauguccaucaagaacgaggaggaggagcagacgcugaccauccucauccggaccggccugcugguggucagcggccucuucccgguguccauccccaucaccgccgccgccugguaccugugggaggugaagaagcagcgcgcggggguccugugggacgugcccagcccgccgcccgugggcaaggccgagcucgaggacggggccuaccggaucaagcagaagggcauccugggguacucccagaucggcgccggcgucuacaaggaggggaccuuccacacgauguggcacgugacccgcggcgccgugcugaugcacaaggggaagcggaucgagcccagcugggcggacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagaccaacacgggcaccaucggggccgugagccuggacuucucccccggcaccagcggcucccccaucguggacaagaaggggaaggucgugggccucuacgggaacggcguggucacccggagcggcacguacguguccgccaucgcgcagaccgagaaguccaucgaggacaaccccgagaucgaggacgacaucuuccgcaagaagcggcugaccaucauggaccugcaccccggggccggcaagaccaagcgcuaccugcccgccaucgugcgggaggccaucaagcgcgggcuccggacgcugauccuggcgccgacccgcgucguggccgccgagauggaggaggcccuccgcggccugcccauccgguaccagacccccgccauccgcgcggagcacaccgggcgggagaucguggaccugaugugccacgccacguucaccaugcgccuccugagccccauccgggucccgaacuacaaccugaucaucauggacgaggcccacuucaccgaccccgccuccaucgccgcgcgcggcuacaucagcacccggguggagaugggcgaggccgccgggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggcggggaacgacaucgccgccugccuccggaagaacggcaagaaggugauccagcugagccgcaagacguucgacuucgaguacaucaagacccggaccaacgacugggacuucgucgugaccacggacaucuccgagaugggcgccaacuucaaggcggagcgcgugaucgacccccggcgcugcaugaagcccgucauccugaccgacggggaggagcgggugauccucgccggccccaugccggugacccacagcuccgccgcccagcgccgggggcgcgucggccgcaaccccaagaacgagaacgaccaguacaucuacaugggggagccccuggagaacgacgaggacugcgcccacuggaaggaggcgaagaugcugcucgacaacaucaacacccccgagggcaucaucccgagcauguucgagcccgagcgggagaagguggacgccaucgacggcgaguaccgccugcgcggggaggcccgcaagacguucgucgaccugaugcggcgcggcgaccuccccguguggcuggccuaccggguggccgcggaggggaucaacuacgccgaccgccgguggugcuucgacggcgucaagaacaaccagauccuggaggagaacguggagguggagaucuggaccaaggagggggagcgcaagaagcucaagccgcgguggcuggacgcccgcaucuacuccgacccccuggcccucaaggaguucaaggaguucgccgcgggccgcaagagccugacccugaaccucaucaccgagaugggccgccugcccacguucaugacccagaaggcccggaacgcccuggacaaccucgccguccugcacaccgcggaggccgggggccgcgccuacaaccacgcccuguccgagcuccccgagacccuggagacgcugcuccugcugacccuccuggccaccgugaccgggggcaucuuccuguuccucaugagcggcaaggggaucggcaagaugacccuggggaugugcugcaucaucacggcguccauccugcucugguacgcccagauccagccgcacuggaucgccgccagcaucauccuggaguucuuccugaucgugcuccugauccccgagcccgagaagcagcggacgccccaggacaaccagcugaccuacgucgugaucgccauccucaccguggucgcggccacgauggccaacgagaugggcuuccuggagaagaccaagaaggacuucgggcugggcuccaucgccacccagcagccggagagcaacauccucgacaucgaccugcgccccgccagcgcguggacccuguacgccguggccacgaccuucaucacccccaugcuccggcacuccaucgagaacagcuccgugaacgucagccugaccgccaucgccaaccaggcgacggugcugaugggccucgggaagggcuggccccuguccaagauggacaucggggugccgcugcucgccaucggcugcuacagccaggucaaccccaucacccugaccgccgcccugcuccugcugguggcgcacuacgccaucaucgggcccggccuccaggccaaggccacccgcgaggcccagaagcgggcggccgccggcaucaugaagaaccccacgguggacgggaucaccgucaucgaccuggacccgauccccuacgaccccaaguucgagaagcagcugggccaggugaugcuccuggugcugugcgucacccaggugcucaugaugcgcaccacgugggcccugugcgaggcccugacccucgcgaccgggcccaucuccacccugugggagggcaacccggggcgcuucuggaacacgaccaucgccgugagcauggccaacaucuuccggggcuccuaccuggccggcgccgggcuccuguucagcaucaugaagaacaccgcgaacacccgccggggcacggggaacaccggcgagacccugggcgagaaguggaagaaccgccucaacgcccuggggaaguccgaguuccagaucuacaagaaguccggcauccaggaggucgaccggacccuggccaaggaggggaucaagcgcggcgagacggaccaccacgccgugucccgggggagcgcgaagcuccgcugguucguggagcggaaccuggucacccccgagggcaaggugguggaccugggcugcgggcgcggcgggugguccuacuacugcggcgggcucaagaacgucaaggaggugaagggccugaccaagggcgggcccggccacgaggagcccaucccgaugagcaccuacggguggaaccuggugcggcuccaguccggcgucgacguguucuucacgccgcccgagaagugcgacacccugcugugcgacaucggggagagcucccccaacccgaccguggaggccggccgcacccuccggguccugaaccugguggagaacuggcucaacaacaacacccaguucugcaucaaggugcugaaccccuacaugcccagcgucaucgagaagauggaggcccugcagcgcaaguacggcggggcccuggugcggaacccgcucagccgcaacuccacgcacgagauguacugggugagcaacgccuccggcaacaucgucagcuccgugaacaugaucagccggaugcugaucaaccgcuucaccaugcggcacaagaaggcgaccuacgagcccgacguggaccugggguccggcacccgcaacaucgggaucgagagcgagacgcccaaccucgacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggucaacggcguggugcggcugcugaccaagccgugggacgucauccccauggugacccagauggccaugaccgacacgacccccuucgggcagcagcgcgucuucaaggagaagguggacacccggacccaggagcccaaggagggcacgaagaagcucaugaagaucaccgccgaguggcuguggaaggagcugggcaagaagaagaccccgcgcaugugcacccgggaggaguucacgcgcaaggugcggagcaacgcggcccucggggccaucuucaccgacgagaacaaguggaaguccgcccgcgaggccgucgaggacagcggcuucugggagcugguggacaaggagcggaaccugcaccucgaggggaagugcgagaccugcguguacaacaugaugggcaagcgcgagaagaagcugggggaguucggcaaggcgaagggcucccgggccaucugguacauguggcugggggcccgcuuccucgaguucgaggcccugggcuuccugaacgaggaccacugguucagccgggagaacucccucagcggggucgagggcgaggggcugcacaagcugggcuacauccuccgcgacgugagcaagaaggagggcggggcgauguacgccgacgacaccgccggcugggacacgcggaucacccuggaggaccugaagaacgaggagauggugaccaaccacauggagggggagcacaagaagcucgccgaggccaucuucaagcugaccuaccagaacaaggucgugcgcgugcagcggcccacgccccgcggcaccgucauggacaucaucucccggcgcgaccagcgggggagcggccagguggugaccuacggccugaacaccuucacgaacauggaggcgcagcucauccgccagauggagggggagggcgucuucaaguccauccagcagcugaccgugaccgaggagaucgccgugaagaacuggcugguccgcguggggcgggagcgccucagccggauggccaucuccggcgacgacugcguggucaagccccuggacgaccgcuucgccagcgcccugaccgcgcucaacgacaugggcaaggugcggaaggacauccagcagugggagccgucccgcggguggaacgacuggacccaggugcccuucugcagccaccacuuccacgagcugaucaugaaggacggccggguccugguggugcccugccgcaaccaggacgagcucaucgggcgggcccgcaucucccagggcgccggguggagccugcgggagaccgccugccugggcaaguccuacgcccagauguggagccucauguacuuccaccgccgggaccugcgccuggcggccaacgccaucugcuccgccguccccagccacugggugccgaccucccggaccaccuggagcauccacgccacgcacgaguggaugaccaccgaggacaugcucaccguguggaaccgcgucuggauccaggagaaccccuggauggaggacaagacgcccguggaguccugggaggagauccccuaccugggcaagcgggaggaccaguggugcgggagccugaucggccucaccagccgcgcgaccugggccaagaacauccagaccgccaucaaccaggugcggucccugaucgggaacgaggaguacacggacuacaugccgagcaugaagcgcuuccgccgggaggaggaggaggccggcguccugugguga

SEQ ID NO: 9679 - RNA, 9876 nt, Artificial Sequence
  derived and/or modified CDS sequence (opt1) from DENV-2__KC762673__SS-prME
accgccggcaucaucaucaugaugauccccaccgugauggccuuccaccugaccacccgcaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucacgaucauggcggccauccuggccuacaccaucggcaccacccacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgccccugagcgugucccuggugcuggucgggguggugacccucuaccugggcgucauggugcaggcggacagcgggugcguggucuccuggaagaacaaggagcugaagugcggcagcggcaucuucaucaccgacaacgugcacaccuggacggagcaguacaaguuccagcccgagagccccuccaagcucgccagcgccauccagaaggcccacgaggaggggaucugcggcauccgguccgugacccgccuggagaaccugauguggaagcagaucaccccggagcucaaccacauccugagcgagaacgaggucaagcugaccaucaugacgggggacaucaagggcaucaugcaggccgggaagcggucccuccgcccccagcccaccgagcugaaguacagcuggaagaccuggggcaaggcgaagaugcuguccaccgagcuccacaaccacacguuccugaucgacggcccggagaccgccgagugccccaacaccaaccgggccuggaacagccuggagguggaggacuacggguucggcguguucaccacgaacaucuggcucaagcugaaggagcgccaggacgucuacugcgacuccaagcugaugagcgccgccaucaaggacaaccgggcggugcacgccgacaugggguacuggaucgaguccgcccucaacgacaccuggaagaucgagaaggccagcuucaucgaggugaaguccugcuacuggcccaagagccacacccugugguccaacggcguccuggagagcgagaugaucauccccaagaacuucgccggcccggugucccagcacaacuaccgccccggguaccacacccagaccgcgggccccuggcaccucgggcggcuggagauggacuucgacuucugcgagggcacgaccguggucgugaccgaggacugcgggaaccgcggccccagccugcggaccacgaccgccagcggcaagcucaucaccgaguggugcugccgcuccugcacccugccgccccugcgguaccgcggggaggacggcugcugguacgggauggagauccggccccucaaggagaaggaggagaaccuggugaacagccuggucacggccggccacgggcagaucgacaacuucucccucggcgugcugggcauggcccuguuccucgaggagaugcugcgcacccggguggggaccaagcacgcgauccugcucgucgccgugagcuucgugacccugaucacgggcaacauguccuuccgcgaccuggggcgcgucauggugauggugggcgccaccaugaccgacgacaucgggaugggcgucaccuaccucgcccugcuggccgcguucaaggugcggcccacguucgccgccggccuccugcugcgcaagcucaccagcaaggagcugaugaugaccaccaucgggaucgugcugcucucccagagcacgaucccggagaccauccuggagcugaccgacgcccucgcccugggcaugauggcgcugaagaucguccggaacauggagaaguaccagcucgccgugaccaucauggccauccugugcguccccaacgccgugauccugcagaacgccuggaagguguccugcacgacccucgcggucgugagcgugagcccccugcugcucaccagcucccagcagaaggccgacuggaucccccuggcccugaccaucaaggggcucaacccgacggccaucuuccugaccacccugagccgcaccuccaagaagcggagcuggccccucaacgaggcgaucauggccgucggcaugguguccauccuggccagcucccugcucaagaacgacauccccaugacgggcccccugguggccgggggccugcucaccgucugcuacgugcugaccgggcgcagcgccgaccuggagcucgagcgggcggccgacgugcgcugggaggagcaggccgagaucagcggcuccagcccgauccuguccaucaccaucagcgaggacggguccaugagcaucaagaacgaggaggaggagcagacgcugaccauccucauccggaccggccugcuggucaucuccggccucuuccccgugagcauccccaucaccgccgccgcgugguaccugugggaggugaagaagcagcgcgccgggguccugugggacgugcccuccccgccgcccgugggcaaggccgagcucgaggacggggccuaccggaucaagcagaagggcauccugggguacagccagaucggcgccggcgucuacaaggaggggaccuuccacacgauguggcacgugacccgcggcgcggugcugaugcacaaggggaagcggaucgagccguccugggccgacgucaagaaggaccucaucagcuacggcgggggcuggaagcuggagggcgaguggaaggagggggaggagguccaggugcuggcccucgagcccggcaagaacccccgcgccguccagaccaagcccgggcuguucaagaccaacacgggcaccaucggggccgugucccuggacuucagcccgggcaccuccggcagccccaucguggacaagaaggggaaggucgugggccucuacgggaacggcguggucacccgguccggcacguacgugagcgcgaucgcccagaccgagaaguccaucgaggacaaccccgagaucgaggacgacaucuuccgcaagaagcggcugaccaucauggaccugcaccccggggccggcaagaccaagcgcuaccugccggccaucgugcgggaggcgaucaagcgcgggcuccggacgcugauccuggcccccacccgcgucguggccgccgagauggaggaggcccuccgcggccugcccauccgguaccagacccccgcgaucaaggccgagcacaccgggcgcgagaucguggaccugaugugccacgccacguucaccaugcggcuccugagcccgauccgcguccccaacuacaaccugaucaucauggacgaggcccacuucaccgaccccgccagcaucgcggcccggggcuacaucuccacccgcguggagaugggcgaggccgccgggaucuucaugacggccacgccgcccggcagccgggaccccuucccccaguccaacgcgcccaucauggacgaggagcgcgagauccccgagcggagcuggaacuccgggcacgagugggugaccgacuucaagggcaagaccgucugguucgugcccagcaucaaggccgggaacgacaucgccgccugccuccgcaagaacggcaagaaggugauccagcugucccggaagacguucgacuucgaguacaucaagacccgcaccaacgacugggacuucgucgugaccacggacaucagcgagaugggcgcgaacuucaaggccgagcgggugaucgacccccgccggugcaugaagcccgucauccugaccgacggggaggagcgcgugauccucgccggcccgaugcccgugacccacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacaccccggagggcaucauccccuccauguucgagcccgagcgcgagaagguggacgccaucgacggcgaguaccggcugcgcggggaggcccggaagacguucguggaccugaugcgccggggcgaccucccggucuggcuggccuaccgcguggcggccgaggggaucaacuacgccgaccggcgcuggugcuucgacggcgucaagaacaaccagauccuggaggagaacguggagguggagaucuggaccaaggagggggagcggaagaagcucaagccccgcuggcuggacgcccggaucuacagcgacccccuggcccucaaggaguucaaggaguucgcggccggccgcaagucccugacccugaaccucaucaccgagaugggccggcugcccacguucaugacccagaaggcccgcaacgcccuggacaaccucgcgguccugcacaccgccgaggccgggggccgggccuacaaccacgcccugagcgagcucccggagacccuggagacgcugcuccugcugacccuccuggcgaccgugaccgggggcaucuuccuguuccucauguccggcaaggggaucggcaagaugacccuggggaugugcugcaucaucacggccagcauccugcucugguacgcccagauccagccccacuggaucgccgccuccaucauccuggaguucuuccugaucgugcuccugauccccgagcccgagaagcagcgcaccccgcaggacaaccagcugaccuacgucgugaucgcgauccucaccguggucgccgccacgauggccaacgagaugggcuuccuggagaagaccaagaaggacuucgggcugggcagcaucaccacccagcagcccgaguccaacauccucgacaucgaccugcggcccgccagcgcguggacgcuguacgccguggccaccaccuucaucacccccaugcuccgccacagcaucgagaacuccagcgugaacgucucccugacggccaucgccaaccaggcgaccgugcugaugggccucgggaagggcuggccgcugagcaagauggacaucggggugccccugcucgccaucggcugcuacucccaggucaaccccaucacccugaccgccgcccugcuccugcugguggcgcacuacgccaucaucgggcccggccuccaggccaaggccacgcgggaggcccagaagcgcgcggccgccggcaucaugaagaacccgaccguggacgggaucaccgucaucgaccuggaccccauccccuacgaccccaaguucgagaagcagcugggccaggugaugcuccuggugcugugcgucacccaggugcucaugaugcggacgaccugggcccugugcgaggcccugacccucgcgaccgggccgaucagcacgcugugggagggcaaccccgggcgcuucuggaacaccaccaucgccguguccauggccaacaucuuccgcggcagcuaccuggccggcgccgggcuccuguucuccaucaugaagaacaccgcgaacacgcggcgcggcaccgggaacaccggcgagacccugggcgagaaguggaagaaccggcucaacgcccuggggaaguccgaguuccagaucuacaagaaguccggcauccaggaggucgaccgcacgcuggccaaggaggggaucaagcggggcgagaccgaccaccacgccgugagccgcggguccgcgaagcuccggugguucguggagcgcaaccuggucacccccgagggcaaggugguggaccugggcugcgggcggggcggguggagcuacuacugcggcgggcucaagaacgucaaggaggugaagggccugaccaagggcgggcccggccacgaggagccgauccccauguccacguacggguggaaccuggugcgccuccagagcggcgucgacguguucuucacgccgcccgagaagugcgacacccugcugugcgacaucggggaguccagcccgaaccccaccguggaggccggccggacccuccgcguccugaaccugguggagaacuggcucaacaacaacacgcaguucugcaucaaggugcugaaccccuacaugccguccgucaucgagaagauggaggcccugcagcggaaguacggcggggcccuggugcgcaacccccucagccggaacagcacccacgagauguacuggguguccaacgccagcggcaacaucgucuccagcgugaacaugaucucccgcaugcugaucaaccgguucaccaugcgccacaagaaggcgaccuacgagcccgacguggaccuggggagcggcacgcggaacaucgggaucgaguccgagauccccaaccucgacaucaucggcaagcgcaucgagaagaucaagcaggagcacgagaccagcuggcacuacgaccaggaccacccguaccgcaccugggccuaccacggcuccuacgagaccaagcagacggggagcgccuccagcauggucaacggcguggugcggcugcugaccaagcccugggacgucauccccauggugacccagauggccaugaccgacacgacccccuucgggcagcagcgcguguucaaggagaaggucgacacccggacccaggagccgaaggagggcacgaagaagcucaugaagaucaccgccgaguggcuguggaaggagcugggcaagaagaagacgccccgcaugugcacccgggaggaguucacgcgcaaggugcgguccaacgcggcccucggggccaucuucaccgacgagaacaaguggaaguccgcccgcgaggccgucgaggacuccggcuucugggagcugguggacaaggagcggaaccugcaccucgaggggaagugcgagaccugcguguacaacaugaugggcaagcgcgagaagaagcugggggaguucggcaaggcgaagggcagccgggccaucugguacauguggcugggggcccgcuuccucgaguucgaggcccugggcuuccugaacgaggaccacugguucucccgggagaacagccucuccggggucgagggcgaggggcugcacaagcugggcuacauccuccgcgacgugagcaagaaggagggcggggcgauguacgccgacgacaccgccggcugggacacgcggaucacccuggaggaccugaagaacgaggagauggugaccaaccacauggagggggagcacaagaagcucgccgaggccaucuucaagcugaccuaccagaacaaggucgugcgcgugcagcggcccacgccccgcggcaccgucauggacaucaucagccggcgcgaccagcggggguccggccagguggugaccuacggccugaacaccuucacgaacauggaggcgcagcucauccgccagauggagggggagggcgucuucaagagcauccagcagcugaccgugaccgaggagaucgccgugaagaacuggcugguccgcguggggcgggagcgccucucccggauggccaucagcggcgacgacugcguggucaagccgcuggacgaccgcuucgccuccgcccugaccgcgcucaacgacaugggcaaggugcggaaggacauccagcagugggagcccagccgcggguggaacgacuggacccaggugcccuucugcucccaccacuuccacgagcugaucaugaaggacggccggguccugguggugcccugccgcaaccaggacgagcucaucgggcgggcccgcaucagccagggcgccggguggucccugcgggagaccgccugccugggcaagagcuacgcccagauguggucccucauguacuuccaccgccgggaccugcgccuggcggccaacgccaucugcagcgccgucccgucccacugggugcccaccagccggaccaccugguccauccacgccacgcacgaguggaugaccaccgaggacaugcucaccguguggaaccgcgucuggauccaggagaaccccuggauggaggacaagacgcccguggagagcugggaggagaucccguaccugggcaagcgggaggaccaguggugcgggucccugaucggccucaccagccgcgcgaccugggccaagaacauccagaccgccaucaaccaggugcggagccugaucgggaacgaggaguacacggacuacaugcccuccaugaagcgcuuccgccgggaggaggaggaggccggcguccugugguga

SEQ ID NO: 9680 - RNA, 9876 nt, Artificial Sequence
  derived and/or modified CDS sequence (opt1) from DENV-2__KC762663__SS-prME
accgccgggaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccaccuacuuccagcgggugcugaucuucauccuccugacggccgugacccccuccaugaccaugcgcugcaucgggaucagcaaccgggacuucgucgagggcguguccggcgggagcuggguggacaucguccuggagcacggcuccugcgugaccacgauggcgaagaacaagcccacccucgacuucgagcugaucaagaccgaggccaagcaccccgccacccugcgcaaguacugcaucgaggccaagcucacgaacaccaccaccgccagccggugcccgacgcagggggagcccucccugaacgaggagcaggacaagcgcuucgugugcaagcacagcauggucgaccggggcuggggcaacgggugcggccuguucgggaagggcgggaucgugaccugcgcgauguucacgugcaagaagaacauggagggcaagaucgugcagcccgagaaccucgaguacaccaucgucaucacgccccacuccggcgaggagaacgccguggggaacgacaccggcaagcacgggaaggagaucaaggugaccccgcagagcuccaucaccgaggccgagcugaccggcuacgggacggucaccauggagugcagcccccgcaccggccuggacuucaacgagauggugcuccugcagauggagaacaaggccuggcuggugcaccggcagugguuccucgaccugccccugcccuggcucccgggcgccgacacccagggguccaacuggauccagaaggagacgcuggucaccuucaagaacccccacgcgaagaagcaggacguggucgugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaagguggucaaggagaucgccgagacccagcacggcacgaucgugauccgcgugcaguacgagggggacggcagccccugcaagauccccuucgagaucaccgaccuggagaagcggcacguccugggccgccucaucaccgugaacccgaucgugaccgagaaggacucccccgucaacaucgaggcggagccgcccuucggggacagcuacaucaucaucggcguggagccggggcagcugaagcuguccugguucaagaagggcagcuccaucgggcagauguucgagacgaccaugcgcggcgccaagcggauggccauccucggcgacaccgccugggacuucgggagccugggcgggguguucaccuccaucggcaaggcccugcaccaggucuucggggcgaucuacggcgccgccuucagcggcguguccuggacgaugaagauccucaucgggguggucaucaccuggaucggcaugaacagccgcuccaccagccuguccgugagccuggugcuggucgggguggugacccucuaccugggcgucauggugcaggccgacuccgggugcguggucagcuggaagaacaaggagcugaagugcggcagcggcaucuucaucacggacaacgugcacaccuggaccgagcaguacaaguuccagcccgagucccccagcaagcucgcguccgccauccagaaggcccacgaggaggggaucugcggcauccggagcgugacccgccuggagaaccugauguggaagcagaucacgcccgagcucaaccacauccuguccgagaacgaggucaagcugaccaucaugaccggggacaucaagggcaucaugcaggccgggaagcggagccuccgcccgcagcccaccgagcugaaguacuccuggaagacguggggcaaggccaagaugcugagcaccgagcuccacaaccacaccuuccugaucgacggccccgagaccgcggagugcccgaacgccaaccgggccuggaacucccuggagguggaggacuacggguucggcguguucacgaccaacaucuggcucaagcugaaggagcgccaggacgccuucugcgacagcaagcugauguccgccgcgaucaaggacaaccgggccguccacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagacggccggccccuggcaccucgggcggcuggagauggacuucgacuucugcgagggcaccaccgugguggucaccgaggacugcgggaaccgcggccccagccugcggacgaccaccgccuccggcaagcucaucaccgaguggugcugccgcagcugcacgcugcccccgcugcgguaccgcggggaggacggcugcugguacgggauggagauccggccccucaaggagaaggaggagaaccuggugaacucccuggugaccgccggccacgggcagaucgacaacuucagccucggcguccugggcauggcgcuguuccucgaggagaugcugcgcacccggguggggaccaagcacgccauccugcucguggccgucuccuucgugacgcugaucaccggcaacaugagcuuccgcgaccuggggcgcgugauggucauggugggcgccaccaugaccgacgacaucgggaugggcgugacguaccucgcccugcuggcggccuucaagguccggcccaccuucgccgccggccuccugcugcgcaagcucaccuccaaggagcugaugaugaccacgaucgggaucacccugcucagccaguccaccauccccgagaccauccuggagcugacggacgcccucgcgcugggcaugauggugcugaagaucgugcggaacauggagaaguaccagcucgccgucaccaucauggccauccugugcgugccgaacgccgucauccugcagaacgccuggaaggugagcugcaccacccucgcgguggucuccgugagcccccugcugcucacguccagccagcagaaggccgacuggaucccccuggcccugaccaucaaggggcucaaccccaccgccaucuuccugaccacgcugucccgcaccagcaagaagcgguccuggccgcucaacgaggcgaucauggccgugggcauggucagcauccuggccuccagccugcucaagaacgacauccccaugaccggcccccugguggccgggggccugcucaccgugugcuacguccugacggggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugaccauccucauccggaccggccugcuggugaucagcggccucuucccggucuccauccccaucacggccgccgcgugguaccugugggaggugaagaagcagcgcgccggggugcugugggacguccccagcccgccgcccguggagaaggccgagcucgaggacggcgccuaccggaucaagcagaaggggauccugggcuacucccagaucggggccggcguguacaaggagggcaccuuccacaccauguggcacgucacccgcggggcggugcugaugcacaagggcaagcggaucgagcccagcugggccgacgugaagaaggaccucaucuccuacgggggcggguggaagcuggagggcgaguggaaggagggcgaggagguccaggugcuggcccucgagcccgggaagaacccccgcgccgugcagacgaagcccggccuguucaagaccagcaccgggaccaucggcgccgucucccuggacuucagccccgggacguccggcagccccaucguggacaagaagggcaagguggucgggcucuacggcaacgggguggugacccgguccggcaccuacgucagcgcgaucgcccagaccgagaaguccaucgaggacaaccccgagaucgaggacgacaucuuccgcaagaagcggcugacgaucauggaccugcaccccggcgccgggaagaccaagcgcuaccugcccgccaucgugcgggaggcgaucaagcgcggccuccggacccugauccuggccccgacccgcguggucgccgccgagauggaggaggcccuccgcgggcugcccauccgguaccagacgcccgcgauccgcgccgagcacaccggccgggagaucguggaccugaugugccacgccaccuucaccaugcgccuccugucccccauccgggugccgaacuacaaccugaucaucauggacgaggcccacuucacggaccccgccagcaucgcggcccgcggguacaucuccacccgggucgagaugggcgaggccgccggcaucuucaugaccgccacgccgcccgggagccgcgacccguucccccaguccaacgcgcccaucauggacgaggagcgggagauccccgagcgcagcuggaacuccggccacgagugggugacggacuucaaggggaagaccgugugguucgucccgagcaucaaggccggcaacgacaucgccgccugccuccggaagaacgggaagaaggugauccagcugucccgcaagaccuucgacuucgaguacaucaagacccggacgaacgacugggacuucguggucaccaccgacaucagcgagaugggcgcgaacuucaaggccgagcgcgugaucgacccccggcgcugcaugaagcccgugauccugaccgacggcgaggagcgggucauccucgccgggcccaugccggugacgcacuccagcgccgcccagcgccggggccgcguggggcgcaaccccaagaacgagaacgaccaguacaucuacaugggcgagccccuggagaacgacgaggacugcgcgcacuggaaggaggccaagaugcugcucgacaacaucaacacccccgaggggaucaucccguccauguucgagcccgagcgggagaaggucgacgccaucgacggcgaguaccgccugcggggcgaggcccgcaagaccuucguggaccugaugcggcgcggggaccuccccguguggcuggccuaccgggucgcggccgagggcaucaacuacgccgaccgccgguggugcuucgacggggugaagaacaaccagauccuggaggagaacgucgagguggagaucuggaccaaggagggcgagcgcaagaagcucaagccgcgguggcuggacgcccgcaucuacagcgacccccuggcccucaaggaguucaaggaguucgcggccgggcggaagucccugacgcugaaccucaucaccgagaugggccgccugcccaccuucaugacccagaaggcccggaacgcccuggacaaccucgcggugcugcacacggccgaggccggcgggcgcgccuacaaccacgcccugagcgagcuccccgagacccuggagacccugcuccugcugacccuccuggcgaccgucacgggcgggaucuuccuguuccucauguccggcaagggcaucgggaagaugacccugggcaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugacguacguggucaucgcgauccucaccgugguggccgccaccauggccaacgagaugggguuccuggagaagaccaagaaggacuucggccuggggagcaucacgacccagcagccggagagcaacauccucgacaucgaccugcgccccgccuccgcguggacccuguacgccgucgccaccacguucaucacccccaugcuccggcacagcaucgagaacuccagcgugaacgugucccugaccgccaucgccaaccaggcgaccguccugaugggccucggcaagggguggccccugagcaagauggacaucggcgugccgcugcucgccaucgggugcuacucccaggugaaccccaucacgcugaccgccgcccugcuccugcuggucgcgcacuacgccaucaucggccccgggcuccaggccaaggccacccgcgaggcccagaagcgggcggccgccggcaucaugaagaaccccaccguggacggcaucacggugaucgaccuggacccgauccccuacgaccccaaguucgagaagcagcuggggcaggucaugcuccuggugcugugcgugacccagguccucaugaugcgcaccaccugggcccugugcgaggcccugacgcucgcgaccggccccaucagcacccugugggaggggaacccgggccgcuucuggaacaccacgaucgccguguccauggccaacaucuuccgggggagcuaccuggccggcgccggccuccuguucuccaucaugaagaacaccgcgaacacccgccgggggaccggcaacacgggggagacccugggcgagaaguggaagaaccgccucaacgcccugggcaagagcgaguuccagaucuacaagaaguccgggauccaggagguggaccggacccuggccaaggagggcaucaagcgcggggagaccgaccaccacgccgucagccggggcuccgcgaagcuccgcugguucguggagcggaaccuggugacgcccgaggggaaggucguggaccugggcugcggccgcgggggcuggagcuacuacugcgggggccucaagaacgugaaggaggucaaggggcugaccaagggcggccccgggcacgaggagcccaucccgauguccaccuacggcuggaaccuggugcggcuccagagcgggguggacgucuucuucacgccgcccgagaagugcgacacccugcugugcgacaucggcgaguccagccccaacccgacgguggaggccgggcgcacccuccgggugcugaaccuggucgagaacuggcucaacaacaacacccaguucugcaucaaggugcugaaccccuacaugcccagcgugaucgagaagauggaggcccugcagcgcaaguacggcggcgcccugguccggaacccgcucucccgcaacagcacccacgagauguacuggguguccaacgccagcgggaacaucguguccagcgucaacaugaucucccggaugcugaucaaccgcuucacgaugcggcacaagaaggcgaccuacgagcccgacguggaccugggcagcgggacccgcaacaucggcaucgaguccgagacccccaaccucgacaucaucgggaagcgcaucgagaagaucaagcaggagcacgagacgagcuggcacuacgaccaggaccaccccuacaagaccugggccuaccacggcuccuacgagaccaagcagaccggcagcgccuccagcauggugaacggggucgugcggcugcugacgaagccgugggacgugauccccauggucacccagauggccaugaccgacaccacgcccuucggccagcagcgcguguucaaggagaagguggacacccggacccaggagcccaaggaggggaccaagaagcucaugaagaucacggccgaguggcuguggaaggagcugggcaagaagaagaccccgcgcaugugcacccgggaggaguucacccgcaagguccgguccaacgcggcccucggcgccaucuucacggacgagaacaaguggaaguccgcccgcgaggccguggaggacuccggguucugggagcuggucgacaaggagcggaaccugcaccucgagggcaagugcgagaccugcguguacaacaugauggggaagcgcgagaagaagcugggcgaguucgggaaggcgaagggcagccgggccaucugguacauguggcugggcgcccgcuuccucgaguucgaggcccugggguuccugaacgaggaccacugguucucccgggagaacagccucagcggcguggagggggagggccugcacaagcugggguacauccuccgcgacgucuccaagaaggagggcggcgcgauguacgccgacgacaccgccgggugggacacccggaucacgcuggaggaccugaagaacgaggagauggugaccaaccacauggagggcgagcacaagaagcucgccgaggccaucuucaagcugaccuaccagaacaaggugguccgcgugcagcggcccacgccccgcgggacggugauggacaucaucagccggcgcgaccagcggggcuccgggcaggucgugaccuacggccugaacaccuucaccaacauggaggcgcagcucauccgccagauggagggcgaggggguguucaagagcauccagcagcugacggucaccgaggagaucgccgugaagaacuggcuggugaccgucggccgcgagcggcucucccgcauggccaucagcggggacgacugcguggugaagccccuggacgaccgguucgccuccgcccugaccgcgcucaacgacaugggcaagguccgcaaggacauccagcagugggagccgagccggggcuggaacgacuggacccaggugcccuucugcucccaccacuuccacgagcugaucaugaaggacgggcgcgugcuggucgugcccugccggaaccaggacgagcucaucggccgcgcccggaucagccagggggccggcuggucccugcgcgagacggccugccugggcaagagcuacgcccagauguggucccucauguacuuccaccggcgcgaccugcggcuggcggccaacgccaucugcagcgccgugcccucccacugggucccgaccagccgcaccaccugguccauccacgccacgcacgaguggaugaccaccgaggacaugcucaccguguggaaccggguguggauccaggagaaccccuggauggaggacaagacgcccgucgagagcugggaggagauccccuaccugggcaagcgcgaggaccaguggugcggcagccugaucgggcucaccucccgggcgaccugggccaagaacauccagaccgccaucaaccaggugcgcagccugaucggcaacgaggaguacacggacuacaugccguccaugaagcgguuccgccgcgaggaggaggaggccggggugcugugguga

SEQ ID NO: 9681 - RNA, 9876 nt, Artificial Sequence
  derived and/or modified CDS sequence (opt1) from DENV-2__KC762675__SS-prME
accgccggcaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucacgaucauggcggccauccuggccuacaccaucggcaccacccacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaagaccuggggcaaggcgaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuacugcgacagcaagcugauguccgccgccaucaaggacaaccgggcggugcacgccgacaugggguacuggaucgagagcgcccucaacgacaccuggaagaucgagaaggccuccuucaucgaggucaagagcugcuacuggcccaagucccacacccuguggagcaacggcgugcuggaguccgagaugaucauccccaagaacuucgccggccccgugagccagcacaacuaccgcccgggguaccacacccagaccgcgggccccuggcaccucgggcggcuggagauggacuucgacuucugcgagggcacgaccguggucgugaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggucacggccggccacgggcagaucgacaacuucagccucggcgugcugggcauggcccuguuccucgaggagaugcugcgcacccggguggggaccaagcacgcgauccugcucgucgccguguccuucgugacccugaucacgggcaacaugagcuuccgcgaccuggggcgcgucauggugauggugggcgccaccaugaccgacgacaucgggaugggcgucaccuaccucgcccugcuggccgcguucaaggugcggcccacguucgccgccggccuccugcugcgcaagcucaccuccaaggagcugaugaugaccaccaucgggaucgugcugcucagccaguccacgauccccgagaccauccuggagcugaccgacgcccucgcccugggcaugauggcgcugaagaucguccggaacauggagaaguaccagcucgccgugaccaucauggccauccugugcgucccgaacgccgugauccugcagaacgccuggaaggugagcugcacgacccucgcggucguguccgugagcccccugcugcucaccuccagccagcagaaggccgacuggaucccccuggcccugaccaucaaggggcucaaccccacggccaucuuccugaccacccugucccgcaccagcaagaagcgguccuggccgcucaacgaggcgaucauggccgucggcauggugagcauccuggccuccagccugcucaagaacgacauccccaugacgggcccccugguggccgggggccugcucaccgucugcuacgugcugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacgcugaccauccucauccggaccggccugcuggucaucagcggccucuucccgguguccauccccaucaccgccgccgcgugguaccugugggaggugaagaagcagcgcgccgggguccugugggacgugcccagcccgccgcccgugggcaaggccgagcucgaggacggggccuaccggaucaagcagaagggcauccugggguacucccagaucggcgccggcgucuacaaggaggggaccuuccacacgauguggcacgugacccgcggcgcggugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagaccaacacgggcaccaucggggccgugagccuggacuucucccccggcaccagcggcucccccaucguggacaagaaggggaaggucgugggccucuacgggaacggcguggucacccggagcggcacguacguguccgcgaucgcccagaccgagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacgcugauccuggccccgacccgcgucguggccgccgagauggaggaggcccuccgcggccugcccauccgguaccagacccccgcgauccgcgccgagcacaccgggcgggagaucguggaccugaugugccacgccacguucaccaugcgccuccugagccccauccgggucccgaacuacaaccugaucaucauggacgaggcccacuucaccgaccccgccuccaucgcggcccgcggcuacaucagcacccggguggagaugggcgaggccgccgggaucuucaugacggccacgccgcccggcucccgcgacccguucccccagagcaacgcgcccaucauggacgaggagcgggagauccccgagcgcuccuggaacagcgggcacgagugggugaccgacuucaagggcaagaccgucugguucgugccguccaucaaggccgggaacgacaucgccgccugccuccggaagaacggcaagaaggugauccagcugagccgcaagacguucgacuucgaguacaucaagacccggaccaacgacugggacuucgucgugaccacggacaucuccgagaugggcgcgaacuucaaggccgagcgcgugaucgacccccggcgcugcaugaagcccgucauccugaccgacggggaggagcgggugauccucgccggccccaugccggugacccacagcuccgccgcccagcgccgggggcgcgucggccgcaaccccaagaacgagaacgaccaguacaucuacaugggggagccccuggagaacgacgaggacugcgcgcacuggaaggaggccaagaugcugcucgacaacaucaacacccccgagggcaucaucccgagcauguucgagcccgagcgggagaagguggacgccaucgacggcgaguaccgccugcgcggggaggcccgcaagacguucguggaccugaugcggcgcggcgaccuccccgucuggcuggccuaccggguggcggccgaggggaucaacuacgccgaccgccgguggugcuucgacggcgucaagaacaaccagauccuggaggagaacguggagguggagaucuggaccaaggagggggagcgcaagaagcucaagccgcgguggcuggacgcccgcaucuacuccgacccccuggcccucaaggaguucaaggaguucgcggccggccgcaagagccugacccugaaccucaucaccgagaugggccgccugcccacguucaugacccagaaggcccggaacgcccuggacaaccucgcgguccugcacaccgccgaggccgggggccgcgccuacaaccacgcccuguccgagcuccccgagacccuggagacgcugcuccugcugacccuccuggcgaccgugaccgggggcaucuuccuguuccucaugagcggcaaggggaucggcaagaugacccuggggaugugcugcaucaucacggccuccauccugcucugguacgcccagauccagccgcacuggaucgccgccagcaucauccuggaguucuuccugaucgugcuccugauccccgagcccgagaagcagcggacgccccaggacaaccagcugaccuacgucgugaucgcgauccucaccguggucgccgccacgauggccaacgagaugggcuuccuggagaagaccaagaaggacuucgggcugggcuccaucaccacccagcagccggagagcaacauccucgacaucgaccugcgccccgccagcgcguggacgcuguacgccguggccaccaccuucaucacccccaugcuccggcacuccaucgagaacagcuccgugaacgucagccugacggccaucgccaaccaggcgaccgugcugaugggccucgggaagggcuggccccuguccaagauggacaucggggugccgcugcucgccaucggcugcuacagccaggucaaccccaucacccugaccgccgcccugcuccugcugguggcgcacuacgccaucaucgggcccggccuccaggccaaggccacgcgcgaggcccagaagcgggcggccgccggcaucaugaagaaccccaccguggacgggaucaccgucaucgaccuggacccgauccccuacgaccccaaguucgagaagcagcugggccaggugaugcuccuggugcugugcgucacccaggugcucaugaugcgcacgaccugggcccugugcgaggcccugacccucgcgaccgggcccaucuccacgcugugggagggcaacccggggcgcuucuggaacaccaccaucgccgugagcauggccaacaucuuccggggcuccuaccuggccggcgccgggcuccuguucagcaucaugaagaacaccgcgaacacgcgccggggcaccgggaacaccggcgagacccugggcgagaaguggaagaaccgccucaacgcccuggggaaguccgaguuccagaucuacaagaaguccggcauccaggaggucgaccggacgcuggccaaggaggggaucaagcgcggcgagaccgaccaccacgccgugucccgggggagcgcgaagcuccgcugguucguggagcggaaccuggucacccccgagggcaaggugguggaccugggcugcgggcgcggcgggugguccuacuacugcggcgggcucaagaacgucaaggaggugaagggccugaccaagggcgggcccggccacgaggagcccaucccgaugagcacguacggguggaaccuggugcggcuccaguccggcgucgacguguucuucacgccgcccgagaagugcgacacccugcugugcgacaucggggagagcucccccaacccgaccguggaggccggccgcacccuccggguccugaaccugguggagaacuggcucaacaacaacacgcaguucugcaucaaggugcugaaccccuacaugcccagcgucaucgagaagauggaggcccugcagcgcaaguacggcggggcccuggugcggaacccgcucagccgcaacuccacccacgagauguacugggugagcaacgccuccggcaacaucgucagcuccgugaacaugaucagccggaugcugaucaaccgcuucaccaugcggcacaagaaggcgaccuacgagcccgacguggaccugggguccggcacgcgcaacaucgggaucgagagcgagauccccaaccucgacaucaucggcaagcgcaucgagaagauccagcaggagcacgagaccuccuggcacuacgaccaggaccaccccuaccggaccugggccuaccacggcagcuacgagaccaagcagacgggguccgccagcuccauggucaacggcguggugcgccugcugaccaagccgugggacgucauccccauggugacccagauggccaugaccgacacgacccccuucgggcagcagcggguguucaaggagaaggucgacacccgcacccaggagcccaaggagggcacgaagaagcucaugaagaucaccgccgaguggcuguggaaggagcugggcaagaagaagaccccgcggaugugcacccgcgaggaguucacgcggaaggugcgcagcaacgcggcccucggggccaucuucaccgacgagaacaaguggaaguccgcccgggaggccgucgaggacagcggcuucugggagcugguggacaaggagcgcaaccugcaccucgaggggaagugcgagaccugcguguacaacaugaugggcaagcgggagaagaagcugggggaguucggcaaggcgaagggcucccgcgccaucugguacauguggcugggggcccgguuccucgaguucgaggcccugggcuuccugaacgaggaccacugguucagccgcgagaacucccucagcggggucgagggcgaggggcugcacaagcugggcuacauccuccgggacgugagcaagaaggagggcggggcgauguacgccgacgacaccgccggcugggacacgcgcaucacccuggaggaccugaagaaggaggagauggugaccaaccacauggagggggagcacaagaagcucgccgaggccaucuucaagcugaccuaccagaacaaggucgugcgggugcagcgccccacgccccggggcaccgucauggacaucaucucccgccgggaccagcgcgggagcggccagguggugaccuacggccugaacaccuucacgaacauggaggcgcagcucauccgccagauggagggggagggcgucuucaaguccauccagcagcugaccgugaccgaggagaucgccgugaagaacuggcugguccggguggggcgcgagcggcucagccgcauggccaucuccggcgacgacugcguggucaagccccuggacgaccgguucgccagcgcccugaccgcgcucaacgacaugggcaaggugcgcaaggacauccagcagugggagccgucccggggguggaacgacuggacccaggugcccuucugcagccaccacuuccacgagcugaucaugaaggacggccgcguccugguggugcccugccggaaccaggacgagcucaucgggcgcgcccggaucucccagggcgccggguggagccugcgcgagaccgccugccugggcaaguccuacgcccagauguggagccucauguacuuccaccggcgcgaccugcggcuggcggccaacgccaucugcuccgccguccccagccacugggugccgaccucccgcaccaccuggagcauccacgccacgcacgaguggaugaccaccgaggacaugcucaccguguggaaccgggucuggauccaggagaaccccuggauggaggacaagacgcccguggaguccugggaggagauccccuaccugggcaagcgcgaggaccaguggugcgggagccugaucggccucaccagccgggcgaccugggccaagaacauccagaccgccaucaaccaggugcgcucccugaucgggaacgaggaguacacggacuacaugccgagcaugaagcgcuuccggcgcgaggaggaggaggccggcguccugugguga

SEQ ID NO: 9682 - RNA, 9876 nt, Artificial Sequence
  derived and/or modified CDS sequence (opt1) from DENV-2__KC762671__SS-prME
accgccggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggagguggaggacuacggguucggcguguucaccaccaacaucuggcucaagcugaaggagcgccaggacgucuucugcgacagcaagcugauguccgccgcgaucaaggacagccgggccgugcacgccgacaugggguacuggaucgaguccgcccucaacgacacguggaagaucgagaaggccagcuucaucgaggugaaguccugccacuggcccaagagccacacccugugguccaacggcguccuggagagcgagaugaucauccccaagaacuucgcgggccccgugagccagcacaacuaccgcccgggguaccacacccagaccgccggccccuggcaccucgggcggcuggagauggacuucgacuucugcgagggcaccacgguggucgugaccgaggacugcgggaaccgcggccccucccugcggaccaccacggccagcggcaagcucaucaccgaguggugcugccgcuccugcacccugcccccgcugcgguaccgcggggaggacggcugcugguacgggauggagauccggccccucaaggagaaggaggagaaccuggugaacagccuggucaccgccggccacgggcagaucgacaacuucucccucggcgugcugggcauggcgcuguuccucgaggagaugcugcgcacgcggguggggaccaagcacgccauccugcucgucgccgugagcuucgugacccugaucaccggcaacauguccuuccgcgaccuggggcgcgucauggugauggugggcgccacgaugaccgacgacaucgggaugggcgucaccuaccucgcccugcuggcggccuucaaggugcggcccaccuucgccgccggccuccugcugcgcaagcucacgagcaaggagcugaugaugaccaccaucgggaucgugcugcucucccaggccaccauccccgagacgauccuggagcugaccgacgcgcucgcccugggcaugaugguccugaagaucgugcggaacauggagaaguaccagcucgccgucaccaucauggccauccugugcgugccgaacgccgugauccugcagaacgcguggaaggucagcugcaccacgcucgccgugguguccgucagcccccugcugcucaccuccagccagcagaaggccgacuggaucccccuggcccugaccaucaaggggcucaaccccaccgcgaucuuccugacgacccugucccgcaccagcaagaagcgguccuggccgcucaacgaggccaucauggccgugggcauggugagcauccuggccuccagccugcucaagaacgacauccccaugaccggcccccuggucgccgggggccugcucacggugugcuacgugcugaccgggcgcagcgcggaccuggagcucgagcgggccgccgacguccgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccgguguccauccccaucaccgccgcggccugguaccugugggaggucaagaagcagcgcgccggggugcugugggacgugcccagcccgccgcccgucggcaaggccgagcucgaggacggggccuaccggaucaagcagaagggcauccugggguacucccagaucggcgcgggcguguacaaggaggggaccuuccacaccauguggcacgugacgcgcggcgccguccugaugcacaaggggaagcggaucgagcccagcugggccgacgugaagaaggaccucaucuccuacggcgggggcuggaagcuggagggcgaguggaaggagggggaggaggugcagguccuggcccucgagcccggcaagaacccccgcgccgugcagaccaagcccgggcuguucaagaccaacaccggcacgaucggggcggugagccuggacuucucccccggcaccagcggcucccccaucgucgacaagaaggggaagguggugggccucuacgggaacggcgucgugacccggagcggcaccuacguguccgccaucgcccagacggagaaguccaucgaggacaaccccgagaucgaggacgacaucuuccgcaagaagcggcugaccaucauggaccugcaccccggggccggcaagaccaagcgcuaccugcccgcgaucguccgggaggccaucaagcgcgggcuccggacccugauccuggccccgacgcgcgugguggccgccgagauggaggaggcgcuccgcggccugcccauccgguaccagacccccgccauccgcgccgagcacaccgggcgggagaucgucgaccugaugugccacgccaccuucacgaugcgccuccugagccccauccgggugccgaacuacaaccugaucaucauggacgaggcccacuucaccgaccccgcguccaucgccgcccgcggcuacaucagcacccggguggagaugggcgaggccgccgggaucuucaugaccgcgacgccgcccggcucccgcgacccguucccccagagcaacgcccccaucauggacgaggagcgggagauccccgagcgcuccuggaacagcgggcacgagugggucaccgacuucaagggcaagaccgugugguucgugccguccaucaaggccgggaacgacaucgccgcgugccuccggaagaacggcaagaaggucauccagcugagccgcaagaccuucgacuucgaguacaucaagacgcggaccaacgacugggacuucguggugaccaccgacaucuccgagaugggcgccaacuucaaggccgagcgcgucaucgacccccggcgcugcaugaagcccgugauccugacggacggggaggagcgggugauccucgccggccccaugccggucacccacagcuccgccgcgcagcgccgggggcgcgugggccgcaaccccaagaacgagaacgaccaguacaucuacaugggggagccccuggagaacgacgaggacugcgcccacuggaaggaggccaagaugcugcucgacaacaucaacacccccgagggcaucaucccgagcauguucgagcccgagcgggagaagguggacgccaucgacggcgaguaccgccugcgcggggaggcccgcaagaccuucgucgaccugaugcggcgcggcgaccuccccguguggcuggcguaccgggucgccgccgaggggaucaacuacgccgaccgccgguggugcuucgacggcgugaagaacaaccagauccuggaggagaacguggaggucgagaucuggacgaaggagggggagcgcaagaagcucaagccgcgguggcuggacgcccgcaucuacuccgacccccuggcgcucaaggaguucaaggaguucgccgccggccgcaagagccugacccugaaccucaucaccgagaugggccgccugcccaccuucaugacgcagaaggcccggaacgcgcuggacaaccucgccgugcugcacaccgccgaggccgggggccgcgccuacaaccacgcgcuguccgagcuccccgagacccuggagacccugcuccugcugacgcuccuggccaccgugaccgggggcaucuuccuguuccucaugagcggcaaggggaucggcaagaugacccuggggaugugcugcaucaucaccgccuccauccugcucugguacgcccagauccagccgcacuggaucgccgcgagcaucauccuggaguucuuccugaucguccuccugauccccgagcccgagaagcagcggacgccccaggacaaccagcugaccuacguggugaucgccauccucaccgucguggccgccaccauggccaacgagaugggcuuccuggagaagacgaagaaggacuucgggcugggcuccaucaccacccagcagccggagagcaacauccucgacaucgaccugcgccccgcgagcgccuggacccuguacgccguggccacgaccuucaucacccccaugcuccggcacuccaucgagaacagcuccgucaacgugagccugaccgccaucgcgaaccaggccacggugcugaugggccucgggaagggcuggccccuguccaagauggacaucggggucccgcugcucgccaucggcugcuacagccaggugaaccccaucacccugaccgccgcgcugcuccugcugguggcccacuacgccaucaucgggcccggccuccaggccaaggccacccgcgaggcgcagaagcgggccgccgccggcaucaugaagaaccccacggucgacgggaucaccgugaucgaccuggacccgauccccuacgaccccaaguucgagaagcagcugggccaggugaugcuccugguccugugcgugacccaggugcucaugaugcgcaccacgugggcccugugcgaggcgcugacccucgccaccgggcccaucuccacccugugggagggcaacccggggcgcuucuggaacacgaccaucgccgucagcauggccaacaucuuccggggcuccuaccuggccggcgcggggcuccuguucagcaucaugaagaacaccgccaacacccgccggggcacggggaacaccggcgagacccugggcgagaaguggaagaaccgccucaacgcccuggggaaguccgaguuccagaucuacaagaaguccggcauccaggagguggaccggacccuggccaaggaggggaucaagcgcggcgagacggaccaccacgcggugucccgggggagcgccaagcuccgcugguucgucgagcggaaccuggugacccccgagggcaagguggucgaccugggcugcgggcgcggcgggugguccuacuacugcggcgggcucaagaacgugaaggaggugaagggccugaccaagggcgggcccggccacgaggagcccaucccgaugagcaccuacggguggaaccugguccggcuccaguccggcguggacguguucuucacgccgcccgagaagugcgacacccugcugugcgacaucggggagagcucccccaacccgaccgucgaggccggccgcacccuccgggugcugaaccugguggagaacuggcucaacaacaacacccaguucugcaucaagguccugaaccccuacaugcccagcgugaucgagaagauggaggcccugcagcgcaaguacggcggggcccuggugcggaacccgcucagccgcaacuccacgcacgagauguacugggucagcaacgcguccggcaacaucgugagcuccgugaacaugaucagccggaugcugaucaaccgcuucaccaugcggcacaagaaggccaccuacgagcccgacgucgaccugggguccggcacccgcaacaucgggaucgagagcgagacgcccaaccucgacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgugguccggcugcugaccaagccgugggacgugauccccauggugacccagauggccaugaccgacacgacccccuucgggcagcagcgcgucuucaaggagaagguggacacccggacccaggagcccaaggagggcacgaagaagcucaugaagaucaccgcggaguggcuguggaaggagcugggcaagaagaagaccccgcgcaugugcacccgggaggaguucgcccgcaagguccggagcaacgccgcccucggggccaucuucacggacgagaacaaguggaaguccgcgcgcgaggccguggaggacagcggcuucugggagcugguggacaaggagcggaaccugcaccucgaggggaagugcgagaccugcgucuacaacaugaugggcaagcgcgagaagaagcugggggaguucggcaaggccaagggcucccgggccaucugguacauguggcugggggcgcgcuuccucgaguucgaggcccugggcuuccugaacgaggaccacugguucagccgggagaacucccucagcgggguggagggcgaggggcugcacaagcugggcuacauccuccgcgacgugagcaugaaggagggcggggccauguacgccgacgacaccgccggcugggacacccggaucacgcuggaggaccugaagaacgaggagauggucaccaaccacauggagggggagcacaagaagcucgcggaggccaucuucaagcugaccuaccagaacaagguggugcgcguccagcggcccacgccccggggcacggugauggacaucaucucccggcgcgaccagcgggggagcggccagguggucaccuacggccugaacaccuucaccaacauggaggcccagcucauccgccagauggagggggagggcguguucaaguccauccagcagcugacggugaccgaggagaucgccgucaagaacuggcuggugcgcguggggcgggagcgccucagccggauggccaucuccggcgacgacugcgucgugaagccccuggacgaccgcuucgcgagcgcccugaccgcccucaacgacaugggcaaggugcggaaggacauccagcagugggagccgucccgcggguggaacgacuggacccagguccccuucugcagccaccacuuccacgagcugaucaugaaggacggccgggugcuggugguccccugccgcaaccaggacgagcucaucgggcgggcccgcaucucccagggcgccggguggagccugcgggagacggcgugccugggcaaguccuacgcccagauguggagccucauguacuuccaccgccgggaccugcgccuggccgccaacgccaucugcuccgcggugcccagccacugggugccgaccucccggaccaccuggagcauccacgccacccacgaguggaugacgaccgaggacaugcucaccgucuggaaccgcguguggauccaggagaaccccuggauggaggacaagacccccguggaguccugggaggagauccccuaccugggcaagcgggaggaccaguggugcgggagccugaucggccucacgagccgcgccaccugggccaagaacauccagaccgcgaucaaccagguccggucccugaucgggaacgaggaguacaccgacuacaugccgagcaugaagcgcuuccgccgggaggaggaggaggccggcgugcugugguga

SEQ ID NO: 9683 - RNA, 9876 nt, Artificial Sequence
  derived and/or modified CDS sequence (opt1) from DENV-2__KC762664__SS-prME
accgccggcaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccgugacccccuccaugaccaugcgcugcaucgggaucagcaaccgggacuucgucgagggcguguccggcgggagcuggguggacaucguccuggagcacggcuccugcgugaccacgauggcgaagaacaagcccacccucgacuucgagcugaucaagaccgaggccaagcaccccgccacccugcgcaaguacugcaucgaggccaagcucacgaacaccaccaccgccagccggugcccgacgcagggggagcccucccugaacgaggagcaggacaagcgcuucgugugcaagcacagcauggucgaccggggcuggggcaacgggugcggccuguucgggaagggcgggaucgugaccugcgcgauguucacgugcaagaagaacauggagggcaagaucgugcagcccgagaaccucgaguacaccaucgucaucacgccccacuccggcgaggagaacgccguggggaacgacaccggcaagcacgggaaggagaucaaggugaccccgcagagcuccaucaccgaggccgagcugaccggcuacgggacggucaccauggagugcagcccccgcaccggccuggacuucaacgagauggugcuccugcagauggagaacaaggccuggcuggugcaccggcagugguuccucgaccugccccugcccuggcucccgggcgccgacacccagggguccaacuggauccagaaggagacgcuggucaccuucaagaacccccacgcgaagaagcaggacguggucgugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaagguggucaaggagaucgccgagacccagcacggcacgaucgugauccgcgugcaguacgagggggacggcagccccugcaagauccccuucgagaucaccgaccuggagaagcggcacggccuggggcgccucaucaccgucaacccgaucgugaccgagaaggacucccccgugaacaucgaggcggagccgcccuucggcgacagcuacaucaucaucggggucgagccgggccagcugaagcuguccugguucaagaaggggagcuccaucggccagauguucgagacgaccaugcgcggcgccaagcggauggccauccucggggacaccgccugggacuucggcagccucggcgggguguucaccuccaucgggaaggcccugcaccagguguucggggcgaucuacggcgccgccuucagcggggucuccuggacgaugaagauccucaucggcguggugaucaccuggaucgggaugaacagccgcuccaccagccuguccgucagccuggugcuggugggcgucgugacccucuaccugggggugaugguccaggccgacuccggcugcguggugagcuggaagaacaaggagcugaagugcggcagcgggaucuucaucacggacaacguccacaccuggaccgagcaguacaaguuccagcccgagucccccagcaagcucgcguccgccauccagaaggcccacgaggagggcaucugcgggauccggagcgugacccgccuggagaaccugauguggaagcagaucacgcccgagcucaaccacauccuguccgagaacgaggugaagcugaccaucaugaccggcgacaucaaggggaucaugcaggccggcaagcggagccuccgcccgcagcccaccgagcugaaguacuccuggaagacguggggcaaggccaagaugcugagcaccgagcuccacaaccacaccuuccugaucgacgggcccgagaccgcggagugcccgaacgccaaccgggccuggaacucccuggaggucgaggacuacggcuucgggguguucacgaccaacaucuggcucaagcugaaggagcgccaggacgccuucugcgacagcaagcugauguccgccgcgaucaaggacaaccgggccgugcacgccgacaugggcuacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcggggcccgugagccagcacaacuaccgcccgggcuaccacacccagacggccgggcccuggcaccucggccggcuggagauggacuucgacuucugcgaggggaccaccgucguggugaccgaggacugcggcaaccgcggccccagccugcggacgaccaccgccuccgggaagcucaucaccgaguggugcugccgcagcugcacgcugcccccgcugcgguaccgcggcgaggacgggugcugguacggcauggagauccggccccucaaggagaaggaggagaaccuggucaacucccuggugaccgccgggcacggccagaucgacaacuucagccucggcgugcuggggauggcgcuguuccucgaggagaugcugcgcacccgggucggcaccaagcacgccauccugcucguggccguguccuucgucacgcugaucaccgggaacaugagcuuccgcgaccugggccgcgugauggugauggucggggccaccaugaccgacgacaucggcaugggcgugacguaccucgcccugcuggcggccuucaaggugcggcccaccuucgccgccgggcuccugcugcgcaagcucaccuccaaggagcugaugaugaccacgaucggcaucacccugcucagccaguccaccauccccgagaccauccuggagcugacggacgcccucgcgcuggggaugaugguccugaagaucgugcggaacauggagaaguaccagcucgccgugaccaucauggccauccugugcgucccgaacgccgugauccugcagaacgccuggaaggucagcugcaccacccucgcggugguguccgucagcccccugcugcucacguccagccagcagaaggccgacuggaucccccuggcccugaccaucaagggccucaaccccaccgccaucuuccugaccacgcugucccgcaccagcaagaagcgguccuggccgcucaacgaggcgaucauggccgugggcauggugagcauccuggccuccagccugcucaagaacgacauccccaugaccgggccccuggucgccggcgggcugcucaccgugugcuacgugcugacgggccgcagcgccgaccuggagcucgagcgggcggccgacguccgcugggaggagcaggccgagaucuccgggagcucccccauccugagcaucaccaucuccgaggacggcagcauguccaucaagaacgaggaggaggagcagacccugaccauccucauccggaccggccugcuggugaucagcgggcuguucccgguguccauccccaucacggccgccgcgugguaccugugggaggucaagaagcagcgcgccggcgugcugugggacgugcccagcccgccgcccgucgagaaggccgagcucgaggacggggccuaccggaucaagcagaagggcauccugggguacucccagaucggcgccggcguguacaaggaggggaccuuccacaccauguggcacgugacccgcggcgcgguccugaugcacaaggggaagcggaucgagcccagcugggccgacgugaagaaggaccucaucuccuacggcgggggcuggaagcuggagggcgaguggaaggagggggaggaggugcagguccuggcccucgagcccggcaagaacccccgcgccgugcagacgaagcccgggcuguucaagaccagcaccggcaccaucggggccgugucccuggacuucagccccggcacguccggcagccccaucgucgacaagaaggggaagguggugggccucuacgggaacggcgucgugacccgguccggcaccuacgugagcgcgaucgcccagaccgagaaguccaucgaggacaaccccgagaucgaggacgacaucuuccgcaagaagcggcugacgaucauggaccugcaccccggggccggcaagaccaagcgcuaccugcccgccaucguccgggaggcgaucaagcgcgggcuccggacccugauccuggccccgacccgcgugguggccgccgagauggaggaggcccuccgcggccugcccauccgguaccagacgcccgcgauccgcgccgagcacaccgggcgggagaucgucgaccugaugugccacgccaccuucaccaugcgccuccugucccccauccgggugccgaacuacaaccugaucaucauggacgaggcccacuucacggaccccgccagcaucgcggcccgcggcuacaucuccacccggguggagaugggcaaggccgccgggaucuucaugaccgccacgccgcccggcagccgcgacccguucccccaguccaacgcgcccaucauggacgaggagcgggagauccccgagcgcagcuggaacuccgggcacgagugggucacggacuucaagggcaagaccgugugguucgugccgagcaucaaggccgggaacgacaucgccgccugccuccggaagaacggcaagaaggucauccagcugucccgcaagaccuucgacuucgaguacaucaagacccggacgaacgacugggacuucguggugaccaccgacaucagcgagaugggcgcgaacuucaaggccgagcgcgucaucgacccccggcgcugcaugaagcccgugauccugaccgacggggaggagcgggugauccucgccggccccaugccggucacgcacuccagcgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgggagaagguggacgccaucgacggcgaguaccgccugcgcggggaggcccgcaagaccuucgucgaccugaugcggcgcggcgaccuccccguguggcuggccuaccggguggcggccgaggggaucaacuacgccgaccgccgguggugcuucgacggcgucaagaacaaccagauccuggaggagaacguggaggucgagaucuggaccaaggagggggagcgcaagaagcucaagccgcgguggcuggacgcccgcaucuacagcgacccccuggcccucaaggaguucaaggaguucgcggccggccggaagucccugacgcugaaccucaucaccgagaugggccgccugcccaccuucaugacccagaaggcccggaacgcccuggacaaccucgcggugcugcacacggccgaggccgggggccgcgccuacaaccacgcccugagcgagcuccccgagacccuggagacccugcuccugcugacccuccuggcgaccgugaccgggggcaucuuccuguuccucauguccggcaaggggaucggcaagaugacccuggggaugugcugcaucaucaccgccagcauccugcucugguacgcccagauccagccgcacuggaucgccgccuccaucauccuggaguucuuccugaucguccuccugauccccgagcccgagaagcagcggacgccccaggacaaccagcugacguacguggugaucgcgauccucaccgucguggccgccaccauggccaacgagaugggcuuccuggagaagaccaagaaggacuucgggcugggcagcaucacgacccagcagccggagagcaacauccucgacaucgaccugcgccccgccuccgcguggacccuguacgccguggccaccacguucaucacccccaugcuccggcacagcaucgagaacuccagcgucaacgugucccugaccgccaucgccaaccaggcgaccgugcugaugggccucgggaagggcuggccccugagcaagauggacaucggggucccgcugcucgccaucggcugcuacucccaggugaaccccaucacgcugaccgccgcccugcuccugcugguggcgcacuacgccaucaucgggcccggccuccaggccaaggccacccgcgaggcccagaagcgggcggccgccggcaucaugaagaaccccaccgucgacgggaucacggugaucgaccuggacccgauccccuacgaccccaaguucgagaagcagcugggccaggugaugcuccugguccugugcgugacccaggugcucaugaugcgcaccaccugggcccugugcgaggcccugacgcucgcgaccgggcccaucagcacccugugggagggcaacccggggcgcuucuggaacaccacgaucgccgucuccauggccaacaucuuccggggcagcuaccuggccggcgccgggcuccuguucuccaucaugaagaacaccgcgaacacccgccggggcaccgggaacacgggcgagacccugggcgagaaguggaagaaccgccucaacgcccugggcaagagcgaguuccagaucuacaagaaguccggcauccaggagguggaccggacccuggccaaggaggggaucaagcgcggcgagaccgaccaccacgccgugagccggggguccgcgaagcuccgcugguucgucgagcggaaccuggugacgcccgagggcaagguggucgaccugggcugcgggcgcggcggguggagcuacuacugcggcgggcucaagaacgugaaggaggugaagggccugaccaagggcgggcccggccacgaggagcccaucccgauguccaccuacggguggaaccugguccggcuccagagcggcguggacguguucuucacgccgcccgagaagugcgacacccugcugugcgacaucggggaguccagccccaacccgacggucgaggccggccgcacccuccgggugcugaaccugguggagaacuggcucaacaacaacacccaguucugcaucaagguccugaaccccuacaugcccagcgugaucgagaagauggaggcccugcagcgcaaguacggcggggcccuggugcggaacccgcucucccgcaacagcacccacgagauguacugggucuccaacgccagcggcaacaucguguccagcgugaacaugaucucccggaugcugaucaaccgcuucacgaugcggcacaagaaggcgaccuacgagcccgacgucgaccuggggagcggcacccgcaacaucgggaucgaguccgagacccccaaccucgacaucaucggcaagcgcaucgagaagaucaagcaggagcacgagacgagcuggcacuacgaccaggaccaccccuacaagaccugggccuaccacggcuccuacgagaccaagcagaccgggagcgccuccagcauggugaacggcgugguccggcugcugacgaagccgugggacgugauccccauggugacccagauggccaugaccgacaccacgcccuucgggcagcagcgcgucuucaaggagaagguggacacccggacccaggagcccaaggagggcaccaagaagcucaugaagaucacggccgaguggcuguggaaggagcugggcaagaagaagaccccgcgcaugugcacccgggaggaguucacccgcaaggugcgguccaacgcggcccucggggccaucuucacggacgagaacaaguggaaguccgcccgcgaggccgucgaggacuccggcuucugggagcugguggacaaggagcggaaccugcaccucgaggggaagugcgagaccugcgucuacaacaugaugggcaagcgcgagaagaagcugggggaguucggcaaggcgaagggcagccgggccaucugguacauguggcugggggcccgcuuccucgaguucgaggcccugggcuuccugaacgaggaccacugguucucccgggagaacagccucagcgggguggagggcgaggggcugcacaagcugggcuacauccuccgcgacguguccaagaaggagggcggggcgauguacgccgacgacaccgccggcugggacacccggaucacgcuggaggaccugaagaacgaggagauggucaccaaccacauggagggggagcacaagaagcucgccgaggccaucuucaagcugaccuaccagaacaagguggugcgcguccagcggcccacgccccggggcacggugauggacaucaucagccggcgcgaccagcggggguccggccagguggucaccuacggccugaacaccuucaccaacauggaggcgcagcucauccgccagauggagggggagggcguguucaagagcauccagcagcugacggugaccgaggagaucgccgucaagaacuggcuggugaccguggggcgcgagcggcucucccgcauggccaucagcggcgacgacugcgucgugaagccccuggacgaccgguucgccuccgcccugaccgcgcucaacgacaugggcaaggugcgcaaggacauccagcagugggagccgagccggggguggaacgacuggacccagguccccuucugcucccaccacuuccacgagcugaucaugaaggacggccgcgugcuggugguccccugccggaaccaggacgagcucaucgggcgcgcccggaucagccagggcgccggguggucccugcgcgagacggccugccugggcaagagcuacgcccagauguggucccucauguacuuccaccggcgcgaccugcggcuggcggccaacgccaucugcagcgccgugcccucccacugggugccgaccagccgcaccaccugguccauccacgccacgcacgaguggaugaccaccgaggacaugcucaccgucuggaaccggguguggauccaggagaaccccuggauggaggacaagacgcccgugggcagcugggaggagauccccuaccuggggaagcgcgaggaccaguggugcggcagccugaucgggcucaccucccgggcgaccugggccaagaacauccagaccgccaucaaccagguccgcagccugaucggcaacgaggaguacacggacuacaugccguccaugaagcgguuccgccgcgaggaggaggaggccggggugcugugguga

SEQ ID NO: 9684 - RNA, 9876 nt, Artificial Sequence
  derived and/or modified CDS sequence (opt1) from DENV-2__KC762674__SS-prME
accgccggcaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucacgaucauggcggccauccuggccuacaccaucggcaccacccacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaagaccuggggcaaggcgaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuacugcgacagcaagcugauguccgccgccaucaaggacaaccgggcggugcacgccgacaugggguacuggaucgagagcgcccucaacgacaccuggaagaucgagaaggccuccuucaucgaggucaagagcugcuacuggcccaagucccacacccuguggagcaacggcgugcuggaguccgagaugaucauccccaagaacuucgccggccccgugagccagcacaacuaccgcccgggguaccacacccagaccgcgggccccuggcaccucgggcggcuggagauggacuucgacuucugcgagggcacgaccguggucgugaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggucacggccggccacgggcagaucgacaacuucagccucggcgugcugggcauggcccuguuccucgaggagaugcugcgcacccggguggggaccaagcacgcgauccugcucgucgccguguccuucgugacccugaucacgggcaacaugagcuuccgcgaccuggggcgcgucauggugauggugggcgccaccaugaccgacgacaucgggaugggcgucaccuaccucgcccugcuggccgcguucaaggugcggcccacguucgccgccggccuccugcugcgcaagcucaccuccaaggagcugaugaugaccaccaucgggaucgugcugcucagccaguccacgauccccgagaccauccuggagcugaccgacgcccucgcccugggcaugauggcgcugaagaucguccggaacauggagaaguaccagcucgccgugaccaucauggccauccugugcgucccgaacgccgugauccugcagaacgccuggaaggugagcugcacgacccucgcggucguguccgugagcccccugcugcucaccuccagccagcagaaggccgacuggaucccccuggcccugaccaucaaggggcucaaccccacggccaucuuccugaccacccugucccgcaccagcaagaagcgguccuggccgcucaacgaggcgaucauggccgucggcauggugagcauccuggccuccagccugcucaagaacgacauccccaugacgggcccccugguggccgggggccugcucaccgucugcuacgugcugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacgcugaccauccucauccggaccggccugcuggucaucagcggccucuucccgguguccauccccaucaccgccgccgcgugguaccugugggaggugaagaagcagcgcgccgggguccugugggacgugcccagcccgccgcccgugggcaaggccgagcucgaggacggggccuaccggaucaagcagaagggcauccugggguacucccagaucggcgccggcgucuacaaggaggggaccuuccacacgauguggcacgugacccgcggcgcggugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagaccaacacgggcaccaucggggccgugagccuggacuucucccccggcaccagcggcucccccaucguggacaagaaggggaaggucgugggccucuacgggaacggcguggucacccggagcggcacguacguguccgcgaucgcccagaccgagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacgcugauccuggccccgacccgcgucguggccgccgagauggaggaggcccuccgcggccugcccauccgguaccagacccccgcgauccgcgccgagcacaccgggcgggagaucguggaccugaugugccacgccacguucaccaugcgccuccugagccccauccgggucccgaacuacaaccugaucaucauggacgaggcccacuucaccgaccccgccuccaucgcggcccgcggcuacaucagcacccggguggagaugggcgaggccgccgggaucuucaugacggccacgccgcccggcucccgcgacccguucccccagagcaacgcgcccaucauggacgaggagcgggagauccccgagcgcuccuggaacagcgggcacgagugggugaccgacuucaagggcaagaccgucugguucgugccguccaucaaggccgggaacgacaucgccgccugccuccggaagaacggcaagaaggugauccagcugagccgcaagacguucgacuucgaguacaucaagacccggaccaacgacugggacuucgucgugaccacggacaucuccgagaugggcgcgaacuucaaggccgagcgcgugaucgacccccggcgcugcaugaagcccgucauccugaccgacggggaggagcgggugauccucgccggccccaugccggugacccacagcuccgccgcccagcgccgggggcgcgucggccgcaaccccaagaacgagaacgaccaguacaucuacaugggggagccccuggagaacgacgaggacugcgcgcacuggaaggaggccaagaugcugcucgacaacaucaacacccccgagggcaucaucccgagcauguucgagcccgagcgggagaagguggacgccaucgacggcgaguaccgccugcgcggggaggcccgcaagacguucguggaccugaugcggcgcggcgaccuccccgucuggcuggccuaccggguggcggccgaggggaucaacuacgccgaccgccgguggugcuucgacggcgucaagaacaaccagauccuggaggagaacguggagguggagaucuggaccaaggagggggagcgcaagaagcucaagccgcgguggcuggacgcccgcaucuacuccgacccccuggcccucaaggaguucaaggaguucgcggccggccgcaagagccugacccugaaccucaucaccgagaugggccgccugcccacguucaugacccagaaggcccggaacgcccuggacaaccucgcgguccugcacaccgccgaggccgggggccgcgccuacaaccacgcccuguccgagcuccccgagacccuggagacgcugcuccugcugacccuccuggcgaccgugaccgggggcaucuuccuguuccucaugagcggcaaggggaucggcaagaugacccuggggaugugcugcaucaucacggccuccauccugcucugguacgcccagauccagccgcacuggaucgccgccagcaucauccuggaguucuuccugaucgugcuccugauccccgagcccgagaagcagcggacgccccaggacaaccagcugaccuacgucgugaucgcgauccucaccguggucgccgccacgauggccaacgagaugggcuuccuggagaagaccaagaaggacuucgggcugggcuccaucaccacccagcagccggagagcaacauccucgacaucgaccugcgccccgccagcgcguggacgcuguacgccguggccaccaccuucaucacccccaugcuccggcacuccaucgagaacagcuccgugaacgucagccugacggccaucgccaaccaggcgaccgugcugaugggccucgggaagggcuggccccuguccaagauggacaucggggugccgcugcucgccaucggcugcuacagccaggucaaccccaucacccugaccgccgcccugcuccugcugguggcgcacuacgccaucaucgggcccggccuccaggccaaggccacgcgcgaggcccagaagcgggcggccgccggcaucaugaagaaccccaccguggacgggaucaccgucaucgaccuggacccgauccccuacgaccccaaguucgagaagcagcugggccaggugaugcuccuggugcugugcgucacccaggugcucaugaugcgcacgaccugggcccugugcgaggcccugacccucgcgaccgggcccaucuccacgcugugggagggcaacccggggcgcuucuggaacaccaccaucgccgugagcauggccaacaucuuccggggcuccuaccuggccggcgccgggcuccuguucagcaucaugaagaacaccgcgaacacgcgccggggcaccgggaacaccggcgagacccugggcgagaaguggaagaaccgccucaacgcccuggggaaguccgaguuccagaucuacaagaaguccggcauccaggaggucgaccggacgcuggccaaggaggggaucaagcgcggcgagaccgaccaccacgccgugucccgggggagcgcgaagcuccgcugguucguggagcggaaccuggucacccccgagggcaaggugguggaccugggcugcgggcgcggcgggugguccuacuacugcggcgggcucaagaacgucaaggaggugaagggccugaccaagggcgggcccggccacgaggagcccaucccgaugagcacguacggguggaaccuggugcggcuccaguccggcgucgacguguucuucacgccgcccgagaagugcgacacccugcugugcgacaucggggagagcucccccaacccgaccguggaggccggccgcacccuccggguccugaaccugguggagaacuggcucaacaacaacacgcaguucugcaucaaggugcugaaccccuacaugcccagcgucaucgagaagauggaggcccugcagcgcaaguacggcggggcccuggugcggaacccgcucagccgcaacuccacccacgagauguacugggugagcaacgccuccggcaacaucgucagcuccgugaacaugaucagccggaugcugaucaaccgcuucaccaugcggcacaagaaggcgaccuacgagcccgacguggaccugggguccggcacgcgcaacaucgggaucgagagcgagauccccaaccucgacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggucaacggcguggugcggcugcugaccaagccgugggacgucauccccauggugacccagauggccaugaccgacacgacccccuucgggcagcagcgcguguucaaggagaaggucgacacccggacccaggagcccaaggagggcacgaagaagcucaugaagaucaccgccgaguggcuguggaaggagcugggcaagaagaagaccccgcgcaugugcacccgggaggaguucacgcgcaaggugcggagcaacgcggcccucggggccaucuucaccgacgagaacaaguggaaguccgcccgcgaggccgucgaggacagcggcuucugggagcugguggacaaggagcggaaccugcaccucgaggggaagugcgagaccugcguguacaacaugaugggcaagcgcgagaagaagcugggggaguucggcaaggcgaagggcucccgggccaucugguacauguggcugggggcccgcuuccucgaguucgaggcccugggcuuccugaacgaggaccacugguucagccgggagaacucccucagcggggucgagggcgaggggcugcacaagcugggcuacauccuccgcgacgugagcaagaaggagggcggggcgauguacgccgacgacaccgccggcugggacacgcggaucacccuggaggaccugaagaacgaggagauggugaccaaccacauggagggggagcacaagaagcucgccgaggccaucuucaagcugaccuaccagaacaaggucgugcgcgugcagcggcccacgccccgcggcaccgucauggacaucaucucccggcgcgaccagcgggggagcggccagguggugaccuacggccugaacaccuucacgaacauggaggcgcagcucauccgccagauggagggggagggcgucuucaaguccauccagcagcugaccgugaccgaggagaucgccgugaagaacuggcugguccgcguggggcgggagcgccucagccggauggccaucuccggcgacgacugcguggucaagccccuggacgaccgcuucgccagcgcccugaccgcgcucaacgacaugggcaaggugcggaaggacauccagcagugggagccgucccgcggguggaacgacuggacccaggugcccuucugcagccaccacuuccacgagcugaucaugaaggacggccggguccugguggugcccugccgcaaccaggacgagcucaucgggcgggcccgcaucucccagggcgccggguggagccugcgggagaccgccugccugggcaaguccuacgcccagauguggagccucauguacuuccaccgccgggaccugcgccuggcggccaacgccaucugcuccgccguccccagccacugggugccgaccucccggaccaccuggagcauccacgccacgcacgaguggaugaccaccgaggacaugcucaccguguggaaccgcgucuggauccaggagaaccccuggauggaggacaagacgcccguggaguccugggaggagauccccuaccugggcaagcgggaggaccaguggugcgggagccugaucggccucaccagccgcgcgaccugggccaagaacauccagaccgccaucaaccaggugcggucccugaucgggaacgaggaguacacggacuacaugccgagcaugaagcgcuuccgccgggaggaggaggaggccggcguccugugguga

SEQ ID NO: 9685 - RNA, 9876 nt, Artificial Sequence
  derived and/or modified CDS sequence (opt1) from DENV-2__KC762672__SS-prME
accgccggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcugggagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggagguggaggacuacggguucggcguguucaccaccaacaucuggcucaagcugaaggagcgccaggacgucuucugcgacagcaagcugauguccgccgcgaucaaggacagccgggccgugcacgccgacaugggguacuggaucgaguccgcccucaacgacacguggaagaucgagaaggccagcuucaucgaggugaaguccugccacuggcccaagagccacacccugugguccaacggcguccuggagagcgagaugaucauccccaagaacuucgcgggccccgugagccagcacaacuaccgcccgggguaccacacccagaccgccggccccuggcaccucgggcggcuggagauggacuucgacuucugcgagggcaccacgguggucgugaccgaggacugcgggaaccgcggccccucccugcggaccaccacggccagcggcaagcucaucaccgaguggugcugccgcuccugcacccugcccccgcugcgguaccgcggggaggacggcugcugguacgggauggagauccggccccucaaggagaaggaggagaaccuggugaacagccuggucaccgccggccacgggcagaucgacaacuucucccucggcgugcugggcauggcgcuguuccucgaggagaugcugcgcacgcggguggggaccaagcacgccauccugcucgucgccgugagcuucgugacccugaucaccggcaacauguccuuccgcgaccuggggcgcgucauggugauggugggcgccacgaugaccgacgacaucgggaugggcgucaccuaccucgcccugcuggcggccuucaaggugcggcccaccuucgccgccggccuccugcugcgcaagcucacgagcaaggagcugaugaugaccaccaucgggaucgugcugcucucccaggccaccauccccgagacgauccuggagcugaccgacgcgcucgcccugggcaugaugguccugaagaucgugcggaacauggagaaguaccagcucgccgucaccaucauggccauccugugcgugccgaacgccgugauccugcagaacgcguggaaggucagcugcaccacgcucgccgugguguccgucagcccccugcugcucaccuccagccagcagaaggccgacuggaucccccuggcccugaccaucaaggggcucaaccccaccgcgaucuuccugacgacccugucccgcaccagcaagaagcgguccuggccgcucaacgaggccaucauggccgugggcauggugagcauccuggccuccagccugcucaagaacgacauccccaugaccggcccccuggucgccgggggccugcucacggugugcuacgugcugaccgggcgcagcgcggaccuggagcucgagcgggccgccgacguccgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccgguguccauccccaucaccgccgcggccugguaccugugggaggucaagaagcagcgcgccggggugcugugggacgugcccagcccgccgcccgucggcaaggccgagcucgaggacggggccuaccggaucaagcagaagggcauccugggguacucccagaucggcgcgggcguguacaaggaggggaccuuccacaccauguggcacgugacgcgcggcgccguccugaugcacaaggggaagcggaucgagcccagcugggccgacgugaagaaggaccucaucuccuacggcgggggcuggaagcuggagggcgaguggaaggagggggaggaggugcagguccuggcccucgagcccggcaagaacccccgcgccgugcagaccaagcccgggcuguucaagaccaacaccggcacgaucggggcggugagccuggacuucucccccggcaccagcggcucccccaucgucgacaagaaggggaagguggugggccucuacgggaacggcgucgugacccggagcggcaccuacguguccgccaucgcccagacggagaaguccaucgaggacaaccccgagaucgaggacgacaucuuccgcaagaagcggcugaccaucauggaccugcaccccggggccggcaagaccaagcgcuaccugcccgcgaucguccgggaggccaucaagcgcgggcuccggacccugauccuggccccgacgcgcgugguggccgccgagauggaggaggcgcuccgcggccugcccauccgguaccagacccccgccauccgcgccgagcacaccgggcgggagaucgucgaccugaugugccacgccaccuucacgaugcgccuccugagccccauccgggugccgaacuacaaccugaucaucauggacgaggcccacuucaccgaccccgcguccaucgccgcccgcggcuacaucagcacccggguggagaugggcgaggccgccgggaucuucaugaccgcgacgccgcccggcucccgcgacccguucccccagagcaacgcccccaucauggacgaggagcgggagauccccgagcgcuccuggaacagcgggcacgagugggucaccgacuucaagggcaagaccgugugguucgugccguccaucaaggccgggaacgacaucgccgcgugccuccggaagaacggcaagaaggucauccagcugagccgcaagaccuucgacuucgaguacaucaagacgcggaccaacgacugggacuucguggugaccaccgacaucuccgagaugggcgccaacuucaaggccgagcgcgucaucgacccccggcgcugcaugaagcccgugauccugacggacggggaggagcgggugauccucgccggccccaugccggucacccacagcuccgccgcgcagcgccgggggcgcgugggccgcaaccccaagaacgagaacgaccaguacaucuacaugggggagccccuggagaacgacgaggacugcgcccacuggaaggaggccaagaugcugcucgacaacaucaacacccccgagggcaucaucccgagcauguucgagcccgagcgggagaagguggacgccaucgacggcgaguaccgccugcgcggggaggcccgcaagaccuucgucgaccugaugcggcgcggcgaccuccccguguggcuggcguaccgggucgccgccgaggggaucaacuacgccgaccgccgguggugcuucgacggcgugaagaacaaccagauccuggaggagaacguggaggucgagaucuggacgaaggagggggagcgcaagaagcucaagccgcgguggcuggacgcccgcaucuacuccgacccccuggcgcucaaggaguucaaggaguucgccgccggccgcaagagccugacccugaaccucaucaccgagaugggccgccugcccaccuucaugacgcagaaggcccggaacgcgcuggacaaccucgccgugcugcacaccgccgaggccgggggccgcgccuacaaccacgcgcuguccgagcuccccgagacccuggagacccugcuccugcugacgcuccuggccaccgugaccgggggcaucuuccuguuccucaugagcggcaaggggaucggcaagaugacccuggggaugugcugcaucaucaccgccuccauccugcucugguacgcccagauccagccgcacuggaucgccgcgagcaucauccuggaguucuuccugaucguccuccugauccccgagcccgagaagcagcggacgccccaggacaaccagcugaccuacguggugaucgccauccucaccgucguggccgccaccauggccaacgagaugggcuuccuggagaagacgaagaaggacuucgggcugggcuccaucaccacccagcagccggagagcaacauccucgacaucgaccugcgccccgcgagcgccuggacccuguacgccguggccacgaccuucaucacccccaugcuccggcacuccaucgagaacagcuccgucaacgugagccugaccgccaucgcgaaccaggccacggugcugaugggccucgggaagggcuggccccuguccaagauggacaucggggucccgcugcucgccaucggcugcuacagccaggugaaccccaucacccugaccgccgcgcugcuccugcugguggcccacuacgccaucaucgggcccggccuccaggccaaggccacccgcgaggcgcagaagcgggccgccgccggcaucaugaagaaccccacggucgacgggaucaccgugaucgaccuggacccgauccccuacgaccccaaguucgagaagcagcugggccaggugaugcuccugguccugugcgugacccaggugcucaugaugcgcaccacgugggcccugugcgaggcgcugacccucgccaccgggcccaucuccacccugugggagggcaacccggggcgcuucuggaacacgaccaucgccgucagcauggccaacaucuuccggggcuccuaccuggccggcgcggggcuccuguucagcaucaugaagaacaccgccaacacccgccggggcacggggaacgccggcgagacccugggcgagaaguggaagaaccgccucaacgcccuggggaaguccgaguuccagaucuacaagaaguccggcauccaggagguggaccggacccuggcgaaggaggggaucaagcgcggcgagaccgaccaccacgccgugucccgggggagcgccaagcuccgcugguucgucgagcggaaccuggugacgcccgagggcaagguggucgaccugggcugcgggcgcggcgggugguccuacuacugcggcgggcucaagaacgugaaggaggugaagggccugaccaagggcgggcccggccacgaggagcccaucccgaugagcaccuacggguggaaccugguccggcuccaguccggcguggacguguucuucacgccgcccgagaagugcgacacgcugcugugcgacaucggggagagcucccccaacccgaccgucgaggccggccgcacccuccgggugcugaaccugguggagaacuggcucaacaacaacacccaguucugcaucaagguccugaaccccuacaugcccagcgugaucgagaagauggaggcccugcagcgcaaguacggcggggcgcuggugcggaacccgcucagccgcaacuccacccacgagauguacugggucagcaacgccuccggcaacaucgugagcuccgugaacaugaucagccggaugcugaucaaccgcuucacgaugcggcacaagaaggccaccuacgagcccgacgucgaccugggguccggcacccgcaacaucgggaucgagagcgagacccccaaccucgacaucaucggcaagcgcaucgagaagaucaagcaggagcacgagacguccuggcacuacgaccaggaccaccccuacaagaccugggccuaccacggcagcuacgagaccaagcagaccggguccgccagcuccauggugaacggcgugguccggcugcugacgaagccgugggacgugauccccauggugacccagauggcgaugaccgacaccacgcccuucgggcagcagcgcgucuucaaggagaagguggacacccggacccaggagcccaaggagggcaccaagaagcucaugaagaucacggccgaguggcuguggaaggagcugggcaagaagaagaccccgcgcaugugcacccgggaggaguucgcccgcaagguccggagcaacgccgcccucggggcgaucuucaccgacgagaacaaguggaaguccgcccgcgaggccguggaggacagcggcuucugggagcugguggacaaggagcggaaccugcaccucgaggggaagugcgagacgugcgucuacaacaugaugggcaagcgcgagaagaagcugggggaguucggcaaggccaagggcucccgggcgaucugguacauguggcugggggcccgcuuccucgaguucgaggcccugggcuuccugaacgaggaccacugguucagccgggagaacucccucagcgggguggagggcgaggggcugcacaagcugggcuacauccuccgcgacgugagcaugaaggagggcggggccauguacgccgacgacaccgcgggcugggacacccggaucacccuggaggaccugaagaacgaggagauggucacgaaccacauggagggggagcacaagaagcucgccgaggccaucuucaagcugaccuaccagaacaagguggugcgcguccagcggcccacgccccggggcaccgugauggacaucaucucccggcgcgaccagcgggggagcggccagguggucacguacggccugaacaccuucaccaacauggaggcccagcucauccgccagauggagggggagggcguguucaaguccauccagcagcugaccgugacggaggagaucgccgucaagaacuggcuggugcgcguggggcgggagcgccucagccggauggcgaucuccggcgacgacugcgucgugaagccccuggacgaccgcuucgccagcgcccugaccgcccucaacgacaugggcaaggugcggaaggacauccagcagugggagccgucccgcggguggaacgacuggacccagguccccuucugcagccaccacuuccacgagcugaucaugaaggacggccgggugcuggugguccccugccgcaaccaggacgagcucaucgggcgggcccgcaucucccagggcgcgggguggagccugcgggagaccgccugccugggcaaguccuacgcccagauguggagccucauguacuuccaccgccgggaccugcgccuggccgccaacgcgaucugcuccgccgugcccagccacugggugccgacgucccggaccaccuggagcauccacgccacccacgaguggaugaccacggaggacaugcucaccgucuggaaccgcguguggauccaggagaaccccuggauggaggacaagacccccguggaguccugggaggagauccccuaccugggcaagcgggaggaccaguggugcgggagccugaucggccucaccagccgcgccacgugggcgaagaacauccagaccgccaucaaccagguccggucccugaucgggaacgaggaguacaccgacuacaugccgagcaugaagcgcuuccgccgggaggaggaggaggccggcgugcugugguga

SEQ ID NO: 9686 - RNA, 9876 nt, Artificial Sequence
  derived and/or modified CDS sequence (opt1) from DENV-2__KC762667__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccgugacccccuccaugaccaugcgcugcaucgggaucagcaaccgggacuucgucgagggcguguccggcgggagcuggguggacaucguccuggagcacggcuccugcgugaccacgauggcgaagaacaagcccacccucgacuucgagcugaucaagaccgaggccaagcaccccgccacccugcgcaaguacugcaucgaggccaagcucacgaacaccaccaccgccagccggugcccgacgcagggggagcccucccugaacgaggagcaggacaagcgcuucgugugcaagcacagcauggucgaccggggcuggggcaacgggugcggccuguucgggaagggcgggaucgugaccugcgcgauguucacgugcaagaagaacauggagggcaagaucgugcagcccgagaaccucgaguacaccaucgucaucacgccccacuccggcgaggagaacgccguggggaacgacaccggcaagcacgggaaggagaucaaggugaccccgcagagcuccaucaccgaggccgagcugaccggcuacgggacggucaccauggagugcagcccccgcaccggccuggacuucaacgagauggugcuccugcagauggagaacaaggccuggcuggugcaccggcagugguuccucgaccugccccugcccuggcucccgggcgccgacacccagggguccaacuggauccagaaggagacgcuggucaccuucaagaacccccacgcgaagaagcaggacguggucgugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaagguggucaaggagaucgccgagacccagcacggcacgaucgugauccgcgugcaguacgagggggacggcagccccugcaagauccccuucgagaucauggaccuggagaagcggcacguccugggccgccucaucaccgugaacccgaucgugaccgagaaggacucccccgucaacaucgaggcggagccgcccuucggggacagcuacaucaucaucggcguggagccggggcagcugaagcuguccugguucaagaagggcagcuccaucgggcagauguucgagaccacgaugcgcggcgccaagcggauggccauccucggcgacaccgccugggacuucgggagccugggcgggguguucaccuccaucggcaaggcccugcaccaggucuucggggcgaucuacggcgccgccuucagcggcguguccuggaccaugaagauccucaucgggguggucaucacguggaucggcaugaacagccgcuccaccagccuguccgugagccuggugcuggucgggguggugacccucuaccugggcgucauggugcaggccgacuccgggugcguggucagcuggaagaacaaggagcugaagugcggcagcggcaucuucaucaccgacaacgugcacacguggaccgagcaguacaaguuccagcccgagucccccagcaagcucgcguccgccauccagaaggcccacgaggaggggaucugcggcauccggagcgugacccgccuggagaaccugauguggaagcagaucacccccgagcucaaccacauccuguccgagaacgaggucaagcugacgaucaugaccggggacaucaagggcaucaugcaggccgggaagcggagccuccgcccgcagcccaccgagcugaaguacuccuggaagaccuggggcaaggccaagaugcugagcacggagcuccacaaccacaccuuccugaucgacggccccgagaccgcggagugcccgaacgccaaccgggccuggaacucccuggagguggaggacuacggguucggcguguucaccacgaacaucuggcucaagcugaaggagcgccaggacgccuucugcgacagcaagcugauguccgccgcgaucaaggacaaccgggccguccacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcacgaccgugguggucaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggugacggccggccacgggcagaucgacaacuucagccucggcguccugggcauggcgcuguuccucgaggagaugcugcgcacccggguggggaccaagcacgccauccugcucguggccgucuccuucgugacccugaucacgggcaacaugagcuuccgcgaccuggggcgcgugauggucauggugggcgccaccaugaccgacgacaucgggaugggcgugaccuaccucgcccugcuggcggccuucaagguccggcccacguucgccgccggccuccugcugcgcaagcucaccuccaaggagcugaugaugaccaccaucggggugacgcugcucagccaguccaccauccccgagaccauccuggagcugaccgacgcccucgcgcugggcaugauggugcugaagaucguccggaacauggagaaguaccagcucgccgugacgaucauggccauccugugcgucccgaacgccgugauccugcagaacgccuggaaggugagcugcaccacccucgcggucguguccgugagcccccugcugcucaccuccagccagcagaaggccgacuggaucccccuggcccugacgaucaaggggcucaaccccaccgccaucuuccugaccacccugucccgcacgagcaagaagcgguccuggccgcucaacgaggcgaucauggccgucggcauggugagcauccuggccuccagccugcucaagaacgacauccccaugaccggcccccugguggccgggggccugcucaccgucugcuacgugcugaccgggcgcagcgccgaccuggagcucgagcgggcggccgacgugcgcugggaggagcaggccgagaucuccggcagcucccccauccugagcaucacgaucuccgaggacgggagcauguccaucaagaacgaggaggaggagcagacccugaccauccucauccggaccggccugcuggucaucagcggccucuucccgguguccauccccaucaccgccgccgcgugguaccugugggaggugaagaagcagcgcgccgggguccugugggacgugcccagcccgccgcccgugggcaaggccgagcucgaggacggggccuaccggaucaagcagaagggcauccugggguacucccagaucggcgccggcgucuacaaggaggggacguuccacaccauguggcacgugacccgcggcgcggugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagacgagcaccggcaccaucggggccgugucccuggacuucagccccggcaccuccggcagccccaucguggacaagaaggggaaggucgugggccucuacgggaacggcguggucacgcgguccggcaccuacgugagcgcgaucgcccagaccgagaaguccaucgaggacaaccccgagaucgaggacgacaucuuccgcaagaagcggcugaccaucauggaccugcaccccggggccggcaagacgaagcgcuaccugcccgccaucgugcgggaggcgaucaagcgcgggcuccggacccugauccuggccccgacccgcgucguggccgccgagauggaggaggcccuccgcggccugcccauccgguaccagacccccgcgauccgcgccgagcacacggggcgggagaucguggaccugaugugccacgccaccuucaccaugcgccuccugucccccauccgggucccgaacuacaaccugaucaucauggacgaggcccacuucaccgaccccgccagcaucgcggcccgcggcuacaucuccacgcggguggagaugggcgaggccgccgggaucuucaugaccgccacgccgcccggcagccgcgacccguucccccaguccaacgcgcccaucauggacgaggagcgggagauccccgagcgcagcuggaacuccgggcacgagugggugaccgacuucaagggcaagacggucugguucgugccgagcaucaaggccgggaacgacaucgccgccugccuccggaagaacggcaagaaggugauccagcugucccgcaagaccuucgacuucgaguacaucaagacccggaccaacgacugggacuucgucgugacgaccgacaucagcgagaugggcgcgaacuucaaggccgagcgcgugaucgacccccggcgcugcaugaagcccgucauccugaccgacggggaggagcgggugauccucgccggccccaugccggugacccacuccagcgccgcccagcgccgggggcgcgucggccgcaaccccaagaacgagaacgaccaguacaucuacaugggggagccccuggagaacgacgaggacugcgcgcacuggaaggaggccaagaugcugcucgacaacaucaacacgcccgagggcaucaucccguccauguucgagcccgagcgggagaagguggacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgucaagaacaaccagauccuggaggagaacguggagguggagaucuggaccaaggagggggagcgcaagaagcucaagccgcgguggcuggacgcccgcaucuacagcgacccccuggcccucaaggaguucaaggaguucgcggccggccggaagucccugacccugaaccucaucacggagaugggccgccugcccaccuucaugacccagaaggcccggaacgcccuggacaaccucgcgguccugcacaccgccgaggccgggggccgcgccuacaaccacgcccugagcgagcuccccgagacgcuggagacccugcuccugcugacccuccuggcgaccgugaccgggggcaucuuccuguuccucauguccggcaaggggaucggcaagaugacgcuggggaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugaccuacgucgugaucgcgauccucacgguggucgccgccaccauggccaacgagaugggcuuccuggagaagaccaagaaggacuucgggcugggcagcaucaccacgcagcagccggagagcaacauccucgacaucgaccugcgccccgccuccgcguggacccuguacgccguggccaccaccuucaucacgcccaugcuccggcacagcaucgagaacuccagcgugaacgucucccugaccgccaucgccaaccaggcgaccgugcugaugggccucgggaagggcuggccccugagcaagauggacaucggggugccgcugcucgccaucggcugcuacucccaggucaaccccaucacccugacggccgcccugcuccugcugguggcgcacuacgccaucaucgggcccggccuccaggccaaggccacccgcgaggcccagaagcgggcggccgccggcaucaugaagaaccccaccguggacgggaucaccgucaucgaccuggacccgauccccuacgaccccaaguucgagaagcagcugggccaggugaugcuccuggugcugugcgucacccaggugcucaugaugcgcaccaccugggcccugugcgaggcccugacccucgcgacggggcccaucagcacccugugggagggcaacccggggcgcuucuggaacaccaccaucgccguguccauggccaacaucuuccggggcagcuaccuggccggcgccgggcuccuguucuccaucaugaagaacacggcgaacacccgccggggcaccgggaacaccggcgagacgcugggcgagaaguggaagaaccgccucaacgcccugggcaagagcgaguuccagaucuacaagaaguccggcauccaggaggucgaccggacccuggccaaggaggggaucaagcgcggcgagaccgaccaccacgccgugagccggggguccgcgaagcuccgcugguucguggagcggaaccuggucacccccgagggcaaggugguggaccugggcugcgggcgcggcggguggagcuacuacugcggcgggcucaagaacgucaaggaggugaagggccugacgaagggcgggcccggccacgaggagcccaucccgauguccaccuacggguggaaccuggugcggcuccagagcggcgucgacguguucuucacgccgcccgagaagugcgacacccugcugugcgacaucggggaguccagccccaacccgaccguggaggccggccgcacgcuccggguccugaaccugguggagaacuggcucaacaacaacacccaguucugcaucaaggugcugaaccccuacaugcccagcgucaucgagaagauggaggcccugcagcgcaaguacggcggggcccuggugcggaacccgcucucccgcaacagcacccacgagauguacuggguguccaacgccagcggcaacaucgucuccagcgugaacaugaucucccggaugcugaucaaccgcuucaccaugcggcacaagaaggcgacguacgagcccgacguggaccuggggagcggcacccgcaacaucgggaucgaguccgagacccccaaccucgacaucaucggcaagcgcaucgagaagaucaagcgggagcacgagaccagcuggcacuacgaccaggaccaccccuacaagacgugggccuaccacggcuccuacgagaccaagcagaccgggagcgccuccagcauggucaacggcguggugcgccugcugaccaagccgugggacgucauccccauggugacgcagauggccaugaccgacaccacccccuucgggcagcagcggguguucaaggagaaggucgacacgcgcacccaggagcccaaggagggcaccaagaagcucaugaagaucaccgccgaguggcuguggaaggagcugggcaagaagaagacgccgcggaugugcacccgcgaggaguucacccggaaggugcgcuccaacgcggcccucggggccaucuucaccgacgagaacaaguggaaguccgcccgggaggccgucgaggacuccggcuucugggagcugguggacaaggagcgcaaccugcaccucgaggggaagugcgagacgugcguguacaacaugaugggcaagcgggagaagaagcugggggaguucggcaaggcgaagggcagccgcgccaucugguacauguggcugggggcccgguuccucgaguucgaggcccugggcuuccugaacgaggaccacugguucucccgcgagaacagccucagcggggucgagggcgaggggcugcacaagcugggcuacauccuccgggacguguccaagaaggagggcggggcgauguacgccgacgacaccgccggcugggacacccgcaucacccuggaggaccugaagaacgaggagauggugacgaaccacauggagggggagcacaagaagcucgccgaggccaucuucaagcugaccuaccagaacaaggucgugcgggugcagcgccccacgccccggggcaccgucauggacaucaucagccgccgggaccagcgcggguccggccagguggugacguacggccugaacaccuucaccaacauggaggcgcagcucauccgccagauggagggggagggcgucuucaagagcauccagcaccugaccgugacggaggagaucgccgugaagaacuggcugguccggguggggcgcgagcggcucucccgcauggccaucagcggcgacgacugcguggucaagccccuggacgaccgguucgccuccgcccugaccgcgcucaacgacaugggcaaggugcgcaaggacauccagcagugggagccgagccggggguggaacgacuggacccaggugcccuucugcucccaccacuuccacgagcugaucaugaaggacggccgcguccugguggugcccugccggaaccaggacgagcucaucgggcgcgcccggaucagccagggcgccggguggucccugcgcgagaccgccugccugggcaagagcuacgcccagauguggucccucauguacuuccaccggcgcgaccugcggcuggcggccaacgccaucugcagcgccguccccucccacugggugccgaccagccgcacgaccugguccauccacgccacccacgaguggaugaccacggaggacaugcucaccguguggaaccgggucuggauccaggagaaccccuggauggaggacaagacccccguggagagcugggaggagauccccuaccugggcaagcgcgaggaccaguggugcgggagccugaucggccucaccucccgggcgacgugggccaagaacauccagaccgccaucaaccaggugcgcagccugaucgggaacgaggaguacaccgacuacaugccguccaugaagcgcuuccggcgcgaggaggaggaggccggcguccugugguga

SEQ ID NO: 9687 - RNA, 9876 nt, Artificial Sequence
  derived and/or modified CDS sequence (opt1) from DENV-2__KC762659__SS-prME
accgcgggcaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccacccgggguucacgaucauggcggccauccuggccuacaccaucggcaccaccuacuuccagcgggugcugaucuucauccuccugacggccgugacccccuccaugaccaugcgcugcaucgggaucagcaaccgggacuucgucgagggcguguccggcgggagcuggguggacaucguccuggagcacggcuccugcgugaccacgauggcgaagaacaagcccacccucgacuucgagcugaucaagaccgaggccaagcaccccgccacccugcgcaaguacugcaucgaggccaagcucacgaacaccaccaccgccagccggugcccgacgcagggggagcccucccugaacgaggagcaggacaagcgcuucgugugcaagcacagcauggucgaccggggcuggggcaacgggugcggccuguucgggaagggcgggaucgugaccugcgcgauguucacgugcaagaagaacauggagggcaaggugguccagcccgagaaccucgaguacaccaucgugaucacgccccacuccggcgaggagaacgccguggggaacgacaccggcaagcacgggaaggagaucaaggucaccccgcagagcuccaucaccgaggccgagcugaccggcuacgggacggugaccauggagugcagcccccgcaccggccuggacuucaacgagauggugcuccugcagauggagaacaaggccuggcugguccaccggcagugguuccucgaccugccccugcccuggcucccgggcgccgacacccagggguccaacuggauccagaaggagacgcuggugaccuucaagaacccccacgcgaagaagcaggacgucguggugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaaggucgugaaggagaucgccgagacccagcacggcacgaucgugauccgcguccaguacgagggggacggcagccccugcaagauccccuucgagaucauggaccuggagaagcggcacgugcugggccgccucaucaccgugaacccgaucgucaccgagaaggacucccccgugaacaucgaggcggagccgcccuucggggacagcuacaucaucaucggcguggagccggggcagcugaagcuguccugguucaagaagggcagcuccaucgggcagauguucgagaccacgaugcgcggcgccaagcggauggccauccucggcgacaccgccugggacuucgggagccugggcggggucuucaccuccaucggcaaggcccugcaccagguguucggggcgaucuacggcgccgccuucagcggcguguccuggaccaugaagauccucaucggggucgugaucacguggaucggcaugaacagccgcuccaccagccuguccgugagccugguccugguggggguggucacccucuaccugggcgugauggugcaggccgacuccgggugcgucgugagcuggaagaacaaggagcugaagugcggcagcggcaucuucaucaccgacaacgugcacacguggaccgagcaguacaaguuccagcccgagucccccagcaagcucgcguccgccauccagaaggcccacgaggaggggaucugcggcauccggagcgucacccgccuggagaaccugauguggaagcagaucacccccgagcucaaccacauccuguccgagaacgaggugaagcugacgaucaugaccggggacaucaagggcaucaugcaggccgggaagcggagccuccgcccgcagcccaccgagcugaaguacuccuggaagaccuggggcaaggccaagaugcugagcacggagcuccacaaccacaccuuccugaucgacggccccgagaccgcggagugcccgaacaccaaccgggccuggaacucccuggagguggaggacuacggguucggcgucuucacgaccaacaucuggcucaagcugaaggagcgccaggacguguucugcgacagcaagcugauguccgccgccaucaaggacaaccgggccgugcacgcggacaugggguacuggauggagagcgcccucaacgacaccuggaagaucgagaaggccuccuucaucgaggucaagagcugccacuggcccaagucccacacccuguggagcaacggcgugcuggaguccgagaugaucauccccaagaacuucgccggccccgugagccagcacaacuaccgcccgggguaccacacccagacggccggccccuggcaccucgggcggcuggagauggacuucgacuucugcgagggcaccaccgucguggugaccgaggacugcgggaaccgcggccccagccugcggacgaccaccgcguccggcaagcucaucaccgaguggugcugccgcagcugcacgcugcccccgcugcgguaccgcggggaggacggcugcugguacgggauggagauccggccccucaaggagaaggaggagaaccuggucaacucccuggugaccgccggccacgggcagaucgacaacuucagccucggcgugcugggcauggcccuguuccucgaggagaugcugcgcacccgggucgggaccaagcacgccauccugcucguggcgguguccuucgucacgcugaucaccggcaacaugagcuuccgcgaccuggggcgcgugauggugauggucggcgccaccaugaccgacgacaucgggaugggcgugacguaccucgcccugcuggccgccuucaaggugcggcccaccuucgcggccggccuccugcugcgccggcucaccuccaaggagcugaugaugaccacgaucgggaucguccugcucagccaguccaccauccccgagaccauccuggagcugaccgacgcccucgcccugggcaugauggugcugaagaucguccgcaagauggagaaguaccagcucgccgugacgaucauggcgauccugugcgugccgaacgccgucauccugcagaacgccuggaaggugagcugcaccacccucgccguggucuccgugagcccccugcugcucaccuccagccagcagaaggccgacuggaucccccuggcgcugacgaucaaggggcucaaccccaccgccaucuuccugaccacccugucccggacgagcaagaagcgcuccuggccgcucaacgaggccaucauggccgugggcauggucagcauccuggcguccagccugcucaagaacgacauccccaugaccggcccccugguggccgggggccugcucaccgugugcuacguccugaccgggcggagcgccgaccuggagcucgagcgcgccgccgacgugcggugggaggagcaggcggagaucuccggcagcucccccauccugagcaucacgaucuccgaggacgggagcauguccaucaagaacgaggaggaggagcagacccugaccauccucauccgcaccggccugcuggugaucagcggccucuucccggucuccauccccaucaccgccgccgccugguaccugugggaggugaagaagcagcgggccggggugcugugggacguccccagcccgccgcccgugggcaaggcggagcucgaggacggggccuaccgcaucaagcagaagggcauccugggguacucccagaucggcgccggcguguacaaggaggggacguuccacaccauguggcacgucacccggggcgccgugcugaugcacaaggggaagcgcaucgagcccagcugggccgacgugaagaaggaccucaucuccuacggcgggggcuggaagcuggagggcgaguggaaggagggggaggagguccaggugcuggcgcucgagcccggcaagaacccccgggccgugcagaccaagcccgggcuguucaagacgaacaccggcaccaucggggccgucagccuggacuucucccccggcaccagcggcucccccaucguggacaagaaggggaagguggucggccucuacgggaacggcguggugacgcgcagcggcaccuacgucuccgccaucgcccagaccgagaaguccaucgaggacaaccccgagaucgaggacgacaucuuccggaagaagcgccugaccaucauggaccugcaccccggggcgggcaagacgaagcgguaccugcccgccaucgugcgcgaggccaucaagcgggggcuccgcacccugauccuggccccgacccgcguggucgcggccgagauggaggaggcccuccggggccugcccauccgcuaccagacccccgccauccgggccgagcacacggggcgcgagaucguggaccugaugugccacgcgaccuucaccaugcggcuccugagccccauccgcgugccgaacuacaaccugaucaucauggacgaggcccacuucaccgaccccgccuccaucgccgcccggggcuacaucagcacgcgcgucgagaugggcgaggcggccgggaucuucaugaccgccacgccgcccggcucccgggacccguucccccagagcaacgcccccaucauggacgaggagcgcgagauccccgagcgguccuggaacagcgggcacgagugggugaccgacuucaagggcaagacggugugguucgucccguccaucaaggccgggaacgacaucgcggccugccuccgcaagaacggcaagaaggugauccagcugagccggaagaccuucgacuucgaguacaucaagacccgcaccaacgacugggacuucguggucacgaccgacaucuccgagaugggcgccaacuucaaggccgagcgggugaucgacccccgccggugcaugaagcccgugauccugaccgacggggaggagcgcgucauccucgcgggccccaugccggugacccacagcuccgccgcccagcggcgcgggcgcgugggccggaaccccaagaacgagaacgaccaguacaucuacaugggggagccccuggagaacgacgaggacugcgcccacuggaaggaggccaagaugcugcucgacaacaucaacacgcccgagggcaucaucccgagcauguucgagcccgagcgcgagaaggucgacgcgaucgacggcgaguaccggcugcgcggggaggcccggaagaccuucguggaccugaugcgccggggcgaccuccccgucuggcuggccuaccgcguggccgccgaggggaucaacuacgcggaccggcgcuggugcuucgacggcgugaagaacaaccagauccuggaggagaacgucgagguggagaucuggaccaaggagggggagcggaagaagcucaagccgcgcuggcuggacgcccggaucuacuccgacccccuggcccucaaggaguucaaggaguucgccgccggccgcaagagccugacccugaaccucaucacggagaugggccggcugcccaccuucaugacccagaaggcgcgcaacgcccuggacaaccucgccgugcugcacaccgccgaggccggcgggcgggccuacaaccacgcccuguccgagcuccccgagacgcuggagacccugcuccugcugacccuccuggccaccgucaccggcgggaucuuccuguuccucaugagcgggaaggggaucggcaagaugacgcuggggaugugcugcaucaucaccgccuccauccugcucugguacgcgcagauccagccgcacuggaucgccgccagcaucauccuggaguucuuccugaucgugcuccugauccccgagcccgagaagcagcgcacgccccaggacaaccagcugaccuacguggucaucgccauccucacggugguggccgcgaccauggccaacgagaugggcuuccuggagaagaccaagaaggacuucgggcugggcuccaucaccacgcagcagagcgagagcaacauccucgacaucgaccugcggccggccuccgccuggacccuguacgccgucgcgaccaccuucaucacgcccaugcuccgccacagcaucgagaacuccagcgugaacgugucccugaccgccaucgccaaccaggccaccguccugaugggccucgggaagggcuggccccugagcaagauggacaucggggugccccugcucgccaucggcugcuacucccaggugaacccgaucacccugacggcggcccugcuccugcuggucgcccacuacgccaucaucgggcccggccuccaggcgaaggccacccgggaggcccagaagcgcgccgccgcgggcaucaugaagaaccccaccguggacgggaucaccgugaucgaccuggaccccaucccguacgaccccaaguucgagaagcagcugggccaggucaugcuccuggugcugugcgugacgcagguccucaugaugcgcaccaccugggcccugugcgaggcccugacccucgccacggggcccaucagcacccugugggagggcaaccccgggcgguucuggaacaccaccaucgccguguccauggcgaacaucuuccgcggcagcuaccuggccggcgccgggcuccuguucuccaucaugaagaacacggccaacacccggcgcggcaccgggaacaccggcgagacgcugggcgagaaguggaagaaccggcucaacgcccugggcaagagcgaguuccagaucuacaagaaguccggcauccaggagguggaccgcacccuggcgaaggaggggaucaagcggggcgagaccgaccaccacgccgucagccgcggguccgccaagcuccggugguucguggagcgcaaccuggugaccccggagggcaaggucguggaccugggcugcgggcggggcggguggagcuacuacugcggcgggcucaagaacgugaaggaggucaagggccugacgaagggcgggcccggccacgaggagcccauccccauguccaccuacggguggaaccuggugcgccuccagagcggcguggacgucuucuucaccccgcccgagaagugcgacacccugcugugcgacaucggggaguccagccccaaccccaccguggaggccggccggacgcuccgcgugcugaaccuggucgagaacuggcucaacaacaacacccaguucugcaucaaggugcugaacccguacaugcccagcgugaucgagaagauggaggcgcugcagcggaaguacggcggggcccugguccgcaacccccucucccggaacagcacccacgagauguacuggguguccaacgccagcggcaacaucguguccagcgucaacaugaucucccgcaugcugaucaaccgguucaccaugcgccacaagaaggccacguacgagccggacguggaccuggggagcggcacccgcaacaucgggaucgaguccgagacccccaaccucgacaucaucggcaagcggaucgagaagaucaagcaggagcacgagaccagcuggcacuacgaccaggaccaccccuacaagacgugggccuaccacggcuccuacgagaccaagcagaccgggagcgcguccagcauggugaacggcgucgugcgccugcugaccaagcccugggacgugaucccgauggucacgcagauggccaugaccgacaccacccccuucgggcagcagcggguguucaaggagaaggucgacacgcgcacccaggagcccaaggagggcaccaagaagcucaugaagaucaccgccgaguggcuguggaaggagcugggcaagaagaagacgccccggaugugcacccgcgaggaguucacccggaaggugcgcuccaacgccgcccucggggcgaucuucaccgacgagaacaaguggaaguccgcccgggaggccguggaggacuccggcuucugggagcuggucgacaaggagcgcaaccugcaccucgaggggaagugcgagacgugcguguacaacaugaugggcaagcgggagaagaagcugggggaguucggcaaggccaagggcagccgcgccaucugguacauguggcugggggcgcgguuccucgaguucgaggcccugggcuuccugaacgaggaccacugguucucccgcgagaacagccucagcgggguggagggcgaggggcugcacaagcugggcuacauccuccgggacgucuccaagaaggagggcggggccauguacgccgacgacaccgcgggcugggacacccgcaucacccuggaggaccugaagaacgaggagauggugacgaaccacauggagggggagcacaagaagcucgccgaggccaucuucaagcugaccuaccagaacaaggugguccgggugcagcgcccgacgccccggggcaccgugauggacaucaucagccgccgggaccagcgcggguccggccaggucgugacguacggccugaacaccuucaccaacauggaggcccagcucauccgccagauggagggggagggcguguucaagagcauccagcagcugaccgccacggaggagaucgcggucaagaacuggcuggugcggguggggcgcgagcggcucucccgcauggccaucagcggcgacgacugcgucgugaagccccuggacgaccgguucgccuccgcccugaccgcccucaacgacaugggcaaggugcgcaaggacauccagcagugggagcccagccggggguggaacgacuggacccaggucccguucugcucccaccacuuccacgagcugaucaugaaggacggccgcgugcuggugguccccugccggaaccaggacgagcucaucgggcgcgcgcggaucagccagggcgccggguggucccugcgcgagaccgccugccugggcaagagcuacgcccagauguggucccucauguacuuccaccggcgcgaccugcggcuggccgcgaacgccaucugcagcgccgugcccucccacugggugcccaccagccgcacgaccugguccauccacgccacccacgaguggaugaccacggaggacaugcucaccgucuggaaccggguguggauccaggagaacccguggaucgaggacaagacccccguggagagcugggaggagauccccuaccugggcaagcgcgaggaccaguggugcgggagccugaucggccucaccucccgggccacgugggcgaagaacauccagaccgccaucaaccagguccgcagccugaucgggaacgaggaguacaccgacuacaugcccuccaugaagcgcuuccggcgcgaggaggaggaggccggcgugcugugguga

SEQ ID NO: 9688 - RNA, 9876 nt, Artificial Sequence
  derived and/or modified CDS sequence (opt1) from DENV-2__KC762657__SS-prME
accgcgggcaucaucaucaugaugauccccaccgugaugguguuccaccugaccacccgcaacggggagccccacaugaucgugagccggcaggagaagggcaagagccuccuguucaagaccgagaacggggugaacaugugcacccugauggccauggaccucggcgagcugugcgaggacaccaucaccuacaacugcccccugcuccgccagaacgagcccgaggacaucgacugcuggugcaacagcaccagcaccugggucaccuacgggaccugcaccgcgaccggcgagcaccggcgcgagaagcggagcguggcccuggugccccacgucggcauggggcuggagacgcgcaccgagaccuggauguccagcgagggcgccuggaagcacgcccagcggaucgagaccugggugcuccgccacccgggguucacgaucauggccgcgauccuggccuacaccaucggcaccaccuacuuccagcgggugcugaucuucauccuccugacggccgucacccccuccaugaccaugcgcugcaucgggaucagcaaccgggacuucguggagggcguguccggcgggagcugggucgacaucgugcuggagcacggcuccugcgugaccacgauggccaagaacaagcccacccucgacuucgagcugaucaagaccgaggcgaagcaccccgccacccugcgcaaguacugcaucgaggccaagcucacgaacaccaccaccgccagccggugcccgacgcagggggagcccucccugaacgaggagcaggacaagcgcuucgucugcaagcacagcaugguggaccggggcuggggcaacgggugcggccuguucgggaagggcgggaucgugaccugcgccauguucacgugcaagaagaacauggagggcaaggucgugcagcccgagaaccucgaguacaccaucgugaucacgccccacuccggcgaggagaacgcggucgggaacgacaccggcaagcacgggaaggagaucaaggugaccccgcagagcuccaucaccgaggccgagcugaccggcuacgggacggugaccauggagugcagcccccgcaccggccuggacuucaacgagaugguccuccugcagauggagaacaaggccuggcuggugcaccggcagugguuccucgaccugccccugcccuggcucccgggcgccgacacccagggguccaacuggauccagaaggagacgcuggucaccuucaagaacccccacgccaagaagcaggacguggugguccugggcagccaggagggggcgaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaagguggugaaggagaucgccgagacccagcacggcacgaucgucauccgcgugcaguacgagggggacggcagccccugcaagauccccuucgagaucauggaccuggagaagcggcacgugcugggccgccucaucaccgucaacccgaucgugaccgagaaggacucccccgugaacaucgaggccgagccgcccuucggggacagcuacaucaucaucggcgucgagccggggcagcugaagcuguccugguucaagaagggcagcuccaucgggcagauguucgagaccacgaugcgcggcgcgaagcggauggccauccucggcgacaccgccugggacuucgggagccugggcgggguguucaccuccaucggcaaggcccugcaccagguguucggggccaucuacggcgcggccuucagcggcgucuccuggaccaugaagauccucaucgggguggugaucacguggaucggcaugaacagccgcuccaccagccuguccgucagccuggugcuggugggggucgugacccucuaccugggcgugaugguccaggccgacuccgggugcguggugagcuggaagaacaaggagcugaagugcggcagcggcaucuucaucaccgacaacguccacacguggaccgagcaguacaaguuccagcccgagucccccagcaagcucgccuccgcgauccagaaggcccacgaggaggggaucugcggcauccggagcgugacccgccuggagaaccugauguggaagcagaucacccccgagcucaaccacauccuguccgagaacgaggugaagcugacgaucaugaccggggacaucaagggcaucaugcaggccgggaagcggagccuccgcccgcagcccaccgagcugaaguacuccuggaagaccuggggcaaggccaagaugcugagcacggagcuccacaaccacaccuuccugaucgacggccccgagaccgccgagugcccgaacaccaaccgggcguggaacucccuggaggucgaggacuacggguucggcguguucacgaccaacaucuggcucaagcugaaggagcgccaggacguguucugcgacagcaagcugauguccgccgccaucaaggacaaccgggccguccacgccgacaugggguacuggauggagagcgcgcucaacgacaccuggaagaucgagaaggccuccuucaucgaggucaagagcugccacuggcccaagucccacacccuguggagcaacggcgugcuggaguccgagaugaucauccccaagaacuucgccggccccgugagccagcacaacuaccgcccgggguaccacacccagacggccggccccuggcaccucgggcggcuggagauggacuucgacuucugcgagggcaccaccgugguggucaccgaggacugcgggaaccgcggccccagccugcggacgaccaccgccuccggcaagcucaucaccgaguggugcugccgcagcugcacgcugcccccgcugcgguaccgcggggaggacggcugcugguacgggauggagauccggccccucaaggagaaggaggagaaccuggugaacucccuggugaccgcgggccacgggcagaucgacaacuucagccucggcguccugggcauggcccuguuccucgaggagaugcugcgcacccggguggggaccaagcacgccauccugcucguggccgucuccuucgugacgcugaucaccggcaacaugagcuuccgcgaccuggggcgcgugauggucauggugggcgcgaccaugaccgacgacaucgggaugggcgugacguaccucgcccugcuggccgccuucaagguccggcccaccuucgccgcgggccuccugcugcgccggcucaccuccaaggagcugaugaugaccacgaucgggaucgugcugcucagccaguccaccauccccgagaccauccuggagcugaccgacgcccucgcccugggcaugaugguccugaagaucgugcgcaagauggagaaguaccagcucgccgugacgaucauggccauccugugcgucccgaacgcggugauccugcagaacgccuggaaggugagcugcaccacccucgccgucguguccgugagcccccugcugcucaccuccagccagcagaaggccgacuggaucccccuggcccugacgaucaaggggcucaaccccaccgcgaucuuccugaccacccugucccggacgagcaagaagcgcuccuggccgcucaacgaggccaucauggccgucggcauggugagcauccuggccuccagccugcucaagaacgacauccccaugaccggcccccugguggccggcgggcugcucaccgucugcuacgugcugaccgggcggagcgccgaccuggagcucgagcgcgccgccgacgugcggugggaggagcaggccgagaucuccgggagcucccccauccugagcaucacgaucuccgaggacgggagcauguccaucaagaacgaggaggaggagcagacccugaccauccucauccgcaccggccugcuggucaucagcggccucuucccgguguccauccccaucaccgcggccgccugguaccugugggaggugaagaagcagcgggccgggguccugugggacgugcccagcccgccgcccgugggcaaggccgagcucgaggacggggcguaccgcaucaagcagaagggcauccugggguacucccagaucggcgccggcgucuacaaggaggggacguuccacaccauguggcacgugacccggggcgccgugcugaugcacaaggggaagcgcaucgagcccagcugggccgacgucaagaaggaccucaucuccuacggcgggggcuggaagcuggagggcgaguggaaggagggggaggagguccaggugcuggcccucgagcccggcaagaacccccgggcgguccagaccaagcccgggcuguucaagacgaacaccggcaccaucggggccgugagccuggacuucucccccggcaccagcggcucccccaucguggacaagaaggggaaggucgugggccucuacgggaacggcguggucacgcgcagcggcaccuacguguccgccaucgcccagaccgagaaguccaucgaggacaaccccgagaucgaggacgacaucuuccggaagaagcgccugaccaucauggaccugcaccccggggccggcaagacgaagcgguaccugcccgcgaucgugcgcgaggccaucaagcgggggcuccgcacccugauccuggccccgacccgcgucguggccgcggagauggaggaggcccuccggggccugcccauccgcuaccagacccccgccauccgggccgagcacacggggcgcgagaucguggaccugaugugccacgccaccuucaccaugcggcuccugagccccauccgcgucccgaacuacaaccugaucaucauggacgaggcgcacuucaccgaccccgccuccaucgccgcccggggcuacaucagcacgcgcguggagaugggcgaggccgcggggaucuucaugaccgccacgccgcccggcucccgggacccguucccccagagcaacgcccccaucauggacgaggagcgcgagauccccgagcgguccuggaacagcgggcacgagugggugaccgacuucaagggcaagacggucugguucgugccguccaucaaggccgggaacgacaucgccgcgugccuccgcaagaacggcaagaaggugauccagcugagccggaagaccuucgacuucgaguacaucaagacccgcaccaacgacugggacuucgucgugacgaccgacaucuccgagaugggcgccaacuucaaggccgagcgggugaucgacccccgccggugcaugaagcccgucauccugaccgacggggaggagcgcgugauccucgccggccccaugccggugacccacagcuccgcggcccagcggcgcgggcgcgucggccggaaccccaagaacgagaacgaccaguacaucuacaugggggagccccuggagaacgacgaggacugcgcccacuggaaggaggccaagaugcugcucgacaacaucaacacgcccgagggcaucaucccgagcauguucgagcccgagcgcgagaagguggacgccaucgacggcgaguaccggcugcgcggggaggcgcggaagaccuucgucgaccugaugcgccggggcgaccuccccguguggcuggccuaccgcguggccgccgaggggaucaacuacgccgaccggcgcuggugcuucgacggcgucaagaacaaccagauccuggaggagaacguggagguggagaucuggaccaaggagggggagcggaagaagcucaagccgcgcuggcuggacgcgcggaucuacuccgacccccuggcccucaaggaguucaaggaguucgccgccggccgcaagagccugacccugaaccucaucacggagaugggccggcugcccaccuucaugacccagaaggcccgcaacgcgcuggacaaccucgccguccugcacaccgccgaggccgggggccgggcguacaaccacgcccuguccgagcuccccgagacgcuggagacccugcuccugcugacccuccuggccaccgugaccgggggcaucuuccuguuccucaugagcggcaaggggaucggcaagaugacgcuggggaugugcugcaucaucaccgccuccauccugcucugguacgcccagauccagccgcacuggaucgcggccagcaucauccuggaguucuuccugaucgugcuccugauccccgagcccgagaagcagcgcacgccccaggacaaccagcugaccuacgucgugaucgccauccucacgguggucgccgccaccauggcgaacgagaugggcuuccuggagaagaccaagaaggacuucgggcugggcuccaucaccacgcagcagagcgagagcaacauccucgacaucgaccugcggccggccuccgccuggacccuguacgccguggccaccaccuucaucacgcccaugcuccgccacagcaucgagaacuccagcgugaacgucucccugaccgcgaucgccaaccaggccaccgugcugaugggccucgggaagggcuggccccugagcaagauggacaucggggugccccugcucgccaucggcugcuacucccaggucaacccgaucacccugacggccgcgcugcuccugcugguggcccacuacgccaucaucgggcccggccuccaggccaaggcgacccgggaggcccagaagcgcgccgccgccggcaucaugaagaaccccaccguggacgggaucaccgucaucgaccuggaccccaucccguacgaccccaaguucgagaagcagcugggccaggugaugcuccuggugcugugcgucacccaggugcucaugaugcgcaccaccugggcgcugugcgaggcccugacccucgccacggggcccaucagcacccugugggagggcaaccccgggcgguucuggaacaccaccaucgccguguccauggccaacaucuuccgcggcagcuaccuggcgggcgccgggcuccuguucuccaucaugaagaacacggccaacacccggcgcggcaccgggaacaccggcgagacgcugggcgagaaguggaagaaccggcucaacgcccugggcaagagcgaguuccagaucuacaagaaguccggcauccaggaggucgaccgcacccuggccaaggaggggaucaagcggggcgagaccgaccaccacgcggugagccgcggguccgccaagcuccggugguucguggagcgcaaccuggucaccccggagggcaaggugguggaccugggcugcgggcggggcggguggagcuacuacugcggcgggcucaagaacgucaaggaggugaagggccugacgaagggcgggcccggccacgaggagcccauccccauguccaccuacggguggaaccuggugcgccuccagagcggcgucgacguguucuucaccccgcccgagaagugcgacacccugcugugcgacaucggggaguccagccccaaccccaccguggaggccggccggacgcuccgcguccugaaccugguggagaacuggcucaacaacaacacccaguucugcaucaaggugcugaacccguacaugcccagcgucaucgagaagauggaggcccugcagcggaaguacggcggggcgcuggugcgcaacccccucucccggaacagcacccacgagauguacuggguguccaacgccagcggcaacaucgucuccagcgugaacaugaucucccgcaugcugaucaaccgguucaccaugcgccacaagaaggccacguacgagccggacguggaccuggggagcggcacccgcaacaucgggaucgaguccgagacccccaaccucgacaucaucggcaagcggaucgagaagaucaagcaggagcacgagaccagcuggcacuacgaccaggaccaccccuacaagacgugggccuaccacggcuccuacgagaccaagcagaccgggagcgccuccagcauggucaacggcguggugcgccugcugaccaagcccugggacgucaucccgauggugacgcagauggcgaugaccgacaccacccccuucgggcagcagcgggucuucaaggagaagguggacacgcgcacccaggagcccaaggagggcaccaagaagcucaugaagaucaccgccgaguggcuguggaaggagcugggcaagaagaagacgccccggaugugcacccgcgaggaguucacccggaaggugcgcuccaacgccgcccucggggccaucuucaccgacgagaacaaguggaaguccgcgcgggaggccgucgaggacuccggcuucugggagcugguggacaaggagcgcaaccugcaccucgaggggaagugcgagacgugcguguacaacaugaugggcaagcgggagaagaagcugggggaguucggcaaggccaagggcagccgcgccaucugguacauguggcugggggcccgguuccucgaguucgaggcgcugggcuuccugaacgaggaccacugguucucccgcgagaacagccucagcggggucgagggcgaggggcugcacaagcugggcuacauccuccgggacguguccaagaaggagggcggggccauguacgccgacgacaccgccggcugggacacccgcaucacccuggaggaccugaagaacgaggagauggugacgaaccacauggagggggagcacaagaagcucgcggaggccaucuucaagcugaccuaccagaacaaggucgugcgggugcagcgcccgacgccccggggcaccgucauggacaucaucagccgccgggaccagcgcggguccggccagguggugacguacggccugaacaccuucaccaacauggaggcccagcucauccgccagauggagggggagggcgucuucaagagcauccagcaccugaccgccacggaggagaucgccgugaagaacuggcuggugcgggucgggcgcgagcggcucucccgcauggcgaucagcggcgacgacugcguggugaagccccuggacgaccgguucgccuccgcccugaccgcccucaacgacaugggcaagguccgcaaggacauccagcagugggagcccagccggggguggaacgacuggacccaggugccguucugcucccaccacuuccacgagcugaucaugaaggacggccgcgugcuggucgugcccugccggaaccaggacgagcucaucgggcgcgcccggaucagccagggcgcgggguggucccugcgcgagaccgccugccugggcaagagcuacgcccagauguggucccucauguacuuccaccggcgcgaccugcggcuggccgccaacgcgaucugcagcgccgugcccucccacuggguccccaccagccgcacgaccugguccauccacgccacccacgaguggaugaccacggaggacaugcucaccguguggaaccggguguggauccaggagaacccguggaucgaggacaagacccccgucgagagcugggaggagauccccuaccugggcaagcgcgaggaccaguggugcgggagccugaucggccucaccucccgggccacgugggccaagaacauccagaccgcgaucaaccaggugcgcagccugaucgggaacgaggaguacaccgacuacaugcccuccaugaagcgcuuccggcgcgaggaggaggaggccggcgugcugugguga

SEQ ID NO: 9689 - RNA, 9876 nt, Artificial Sequence
  derived and/or modified CDS sequence (opt1) from DENV-2__KC762666__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccaccuacuuccagcgggugcugaucuucauccuccugacggccgugacccccuccaugaccaugcgcugcaucgggaucagcaaccgggacuucgucgagggcguguccggcgggagcuggguggacaucguccuggagcacggcuccugcgugaccacgauggcgaagaacaagcccacccucgacuucgagcugaucaagaccgaggccaagcaccccgccacccugcgcaaguacugcaucgaggccaagcucacgaacaccaccaccgccagccggugcccgacgcagggggagcccucccugaacgaggagcaggacaagcgcuucgugugcaagcacagcauggucgaccggggcuggggcaacgggugcggccuguucgggaagggcgggaucgugaccugcgcgauguucacgugcaagaagaacauggagggcaagaucgugcagcccgagaaccucgaguacaccaucgucaucacgccccacuccggcgaggagaacgccguggggaacgacaccggcaagcacgggaaggagaucaaggugaccccgcagagcuccaucaccgaggccgagcugaccggcuacgggacggucaccauggagugcagcccccgcaccggccuggacuucaacgagauggugcuccugcagauggagaacaaggccuggcuggugcaccggcagugguuccucgaccugccccugcccuggcucccgggcgccgacacccagggguccaacuggauccagaaggagacgcuggucaccuucaagaacccccacgcgaagaagcaggacguggucgugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaagguggucaaggagaucgccgagacccagcacggcacgaucgugauccgcgugcaguacgagggggacggcagccccugcaagauccccuucgagaucauggaccuggagaagcggcacguccugggccgccucaucaccgugaacccgaucgugaccgagaaggacucccccgucaacaucgaggcggagccgcccuucggggacagcuacaucaucaucggcguggagccggggcagcugaagcuguccugguucaagaagggcagcuccaucgggcagauguucgagaccacgaugcgcggcgccaagcggauggccauccucggcgacaccgccugggacuucgggagccugggcgggguguucaccuccaucggcaaggcccugcaccaggucuucggggcgaucuacggcgccgccuucagcggcguguccuggaccaugaagauccucaucgggguggucaucacguggaucggcaugaacagccgcuccaccagccuguccgugagccuggugcuggucgggguggugacccucuaccugggcgucauggugcaggccgacuccgggugcguggucagcuggaagaacaaggagcugaagugcggcagcggcaucuucaucaccgacaacgugcacacguggaccgagcaguacaaguuccagcccgagucccccagcaagcucgcguccgccauccagaaggcccacgaggaggggaucugcggcauccggagcgugacccgccuggagaaccugauguggaagcagaucacccccgagcucaaccacauccuguccgagaacgaggucaagcugacgaucaugaccggggacaucaagggcaucaugcaggccgggaagcggagccuccgcccgcagcccaccgagcugaaguacuccuggaagaccuggggcaaggccaagaugcugagcacggagcuccacaaccacaccuuccugaucgacggccccgagaccgcggagugcccgaacgccaaccgggccuggaacucccuggagguggaggacuacggguucggcguguucaccacgaacaucuggcucaagcugaaggagcgccaggacgccuucugcgacagcaagcugauguccgccgcgaucaaggacaaccgggccguccacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcacgaccgugguggucaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggugacggccggccacgggcagaucgacaacuucagccucggcguccugggcauggcgcuguuccucgaggagaugcugcgcacccggguggggaccaagcacgccauccugcucguggccgucuccuucgugacccugaucacgggcaacaugagcuuccgcgaccuggggcgcgugauggucauggugggcgccaccaugaccgacgacaucgggaugggcgugaccuaccucgcccugcuggcggccuucaagguccggcccacguucgccgccggccuccugcugcgcaagcucaccuccaaggagcugaugaugaccaccaucgggaucacgcugcucagccaguccaccauccccgagaccauccuggagcugaccgacgcccucgcgcugggcaugauggugcugaagaucgugcggaacauggagaaguaccagcucgccgucacgaucauggccauccugugcgugccgaacgccgucauccugcagaacgccuggaaggugagcugcaccacccucgcgguggucuccgugagcccccugcugcucaccuccagccagcagaaggccgacuggaucccccuggcccugacgaucaaggggcucaaccccaccgccaucuuccugaccacccugucccgcacgagcaagaagcgguccuggccgcucaacgaggcgaucauggccgugggcauggucagcauccuggccuccagccugcucaagaacgacauccccaugaccggcccccugguggccgggggccugcucaccgugugcuacguccugaccgggcgcagcgccgaccuggagcucgagcgggcggccgacgugcgcugggaggagcaggccgagaucuccggcagcucccccauccugagcaucacgaucuccgaggacgggagcauguccaucaagaacgaggaggaggagcagacccugaccauccucauccggaccggccugcuggugaucagcggccucuucccggucuccauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacucccagaucggcgccggcguguacaaggaggggacguuccacaccauguggcacgucacccgcggcgcggugcugaugcacaaggggaagcggaucgagcccagcugggccgacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagacgagcaccggcaccaucggggccgucucccuggacuucagccccggcaccuccggcagccccaucguggacaagaaggggaagguggucggccucuacgggaacggcguggugacgcgguccggcaccuacgucagcgcgaucgcccagaccgagaaguccaucgaggacaaccccgagaucgaggacgacaucuuccgcaagaagcggcugaccaucauggaccugcaccccggggccggcaagacgaagcgcuaccugcccgccaucgugcgggaggcgaucaagcgcgggcuccggacccugauccuggccccgacccgcguggucgccgccgagauggaggaggcccuccgcggccugcccauccgguaccagacccccgcgauccgcgccgagcacacggggcgggagaucguggaccugaugugccacgccaccuucaccaugcgccuccugucccccauccgggugccgaacuacaaccugaucaucauggacgaggcccacuucaccgaccccgccagcaucgcggcccgcggcuacaucuccacgcgggucgagaugggcgaggccgccgggaucuucaugaccgccacgccgcccggcagccgcgacccguucccccaguccaacgcgcccaucauggacgaggagcgggagauccccgagcgcagcuggaacuccgggcacgagugggugaccgacuucaagggcaagacggugugguucgucccgagcaucaaggccgggaacgacaucgccgccugccuccggaagaacggcaagaaggugauccagcugucccgcaagaccuucgacuucgaguacaucaagacccggaccaacgacugggacuucguggucacgaccgacaucagcgagaugggcgcgaacuucaaggccgagcgcgugaucgacccccggcgcugcaugaagcccgugauccugaccgacggggaggagcgggucauccucgccggccccaugccggugacccacuccagcgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacgcccgagggcaucaucccguccauguucgagcccgagcgggagaaggucgacgccaucgacggcgaguaccgccugcgcggggaggcccgcaagaccuucguggaccugaugcggcgcggcgaccuccccguguggcuggccuaccgggucgcggccgaggggaucaacuacgccgaccgccgguggugcuucgacggcgugaagaacaaccagauccuggaggagaacgucgagguggagaucuggaccaaggagggggagcgcaagaagcucaagccgcgguggcuggacgcccgcaucuacagcgacccccuggcccucaaggaguucaaggaguucgcggccggccggaagucccugacccugaaccucaucacggagaugggccgccugcccaccuucaugacccagaaggcccggaacgcccuggacaaccucgcggugcugcacaccgccgaggccgggggccgcgccuacaaccacgcccugagcgagcuccccgagacgcuggagacccugcuccugcugacccuccuggcgaccgucaccgggggcaucuuccuguuccucauguccggcaaggggaucggcaagaugacgcuggggaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugaccuacguggucaucgcgauccucacggugguggccgccaccauggccaacgagaugggcuuccuggagaagaccaagaaggacuucgggcugggcagcaucaccacgcagcagccggagagcaacauccucgacaucgaccugcgccccgccuccgcguggacccuguacgccgucgccaccaccuucaucacgcccaugcuccggcacagcaucgagaacuccagcgugaacgugucccugaccgccaucgccaaccaggcgaccguccugaugggccucgggaagggcuggccccugagcaagauggacaucggggugccgcugcucgccaucggcugcuacucccaggugaaccccaucacccugacggccgcccugcuccugcuggucgcgcacuacgccaucaucgggcccggccuccaggccaaggccacccgcgaggcccagaagcgggcggccgccggcaucaugaagaaccccaccguggacgggaucaccgugaucgaccuggacccgauccccuacgaccccaaguucgagaagcagcugggccaggucaugcuccuggugcugugcgugacgcagguccucaugaugcgcaccaccugggcccugugcgaggcccugacccucgcgacggggcccaucagcacccugugggagggcaacccggggcgcuucuggaacaccaccaucgccguguccauggccaacaucuuccggggcagcuaccuggccggcgccgggcuccuguucuccaucaugaagaacacggcgaacacccgccggggcaccgggaacaccggcgagacgcugggcgagaaguggaagaaccgccucaacgcccugggcaagagcgaguuccagaucuacaagaaguccggcauccaggagguggaccggacccuggccaaggaggggaucaagcgcggcgagaccgaccaccacgccgucagccggggguccgcgaagcuccgcugguucguggagcggaaccuggugacccccgagggcaaggucguggaccugggcugcgggcgcggcggguggagcuacuacugcggcgggcucaagaacgugaaggaggucaagggccugacgaagggcgggcccggccacgaggagcccaucccgauguccaccuacggguggaaccuggugcggcuccagagcggcguggacgucuucuucacgccgcccgagaagugcgacacccugcugugcgacaucggggaguccagccccaacccgaccguggaggccggccgcacgcuccgggugcugaaccuggucgagaacuggcucaacaacaacacccaguucugcaucaaggugcugaaccccuacaugcccagcgugaucgagaagauggaggcccugcagcgcaaguacggcggggcccugguccggaacccgcucucccgcaacagcacccacgagauguacuggguguccaacgccagcggcaacaucguguccagcgucaacaugaucucccggaugcugaucaaccgcuucaccaugcggcacaagaaggcgacguacgagcccgacguggaccuggggagcggcacccgcaacaucgggaucgaguccgagacccccaaccucgacaucaucggcaagcgcaucgagaagaucaagcgggagcacgagaccagcuggcacuacgaccaggaccaccccuacaagacgugggccuaccacggcuccuacgagaccaagcagaccgggagcgccuccagcauggugaacggcgucgugcgccugcugaccaagccgugggacgugauccccauggucacgcagauggccaugaccgacaccacccccuucgggcagcagcggguguucaaggagaagguggacacgcgcacccaggagcccaaggagggcaccaagaagcucaugaagaucaccgccgaguggcuguggaaggagcugggcaagaagaagacgccgcggaugugcacccgcgaggaguucacccggaagguccgcuccaacgcggcccucggggccaucuucaccgacgagaacaaguggaaguccgcccgggaggccguggaggacuccggcuucugggagcuggucgacaaggagcgcaaccugcaccucgaggggaagugcgagacgugcguguacaacaugaugggcaagcgggagaagaagcugggggaguucggcaaggcgaagggcagccgcgccaucugguacauguggcugggggcccgguuccucgaguucgaggcccugggcuuccugaacgaggaccacugguucucccgcgagaacagccucagcgggguggagggcgaggggcugcacaagcugggcuacauccuccgggacgucuccaagaaggagggcggggcgauguacgccgacgacaccgccggcugggacacccgcaucacccuggaggaccugaagaacgaggagauggugacgaaccacauggagggggagcacaagaagcucgccgaggccaucuucaagcugaccuaccagaacaaggugguccgggugcagcgccccacgccccggggcaccgugauggacaucaucagccgccgggaccagcgcggguccggccaggucgugacguacggccugaacaccuucaccaacauggaggcgcagcucauccgccagauggagggggagggcguguucaagagcauccagcagcugaccgucacggaggagaucgccgugaagaacuggcuggugcgggucgggcgcgagcggcucucccgcauggccaucagcggcgacgacugcguggugaagccccuggacgaccgguucgccuccgcccugaccgcgcucaacgacaugggcaagguccgcaaggacauccagcagugggagccgagccggggguggaacgacuggacccaggugcccuucugcucccaccacuuccacgagcugaucaugaaggacggccgcgugcuggucgugcccugccggaaccaggacgagcucaucgggcgcgcccggaucagccagggcgccggguggucccugcgcgagaccgccugccugggcaagagcuacgcccagauguggucccucauguacuuccaccggcgcgaccugcggcuggcggccaacgccaucugcagcgccgugcccucccacugggucccgaccagccgcacgaccugguccauccacgccacccacgaguggaugaccacggaggacaugcucaccguguggaaccggguguggauccaggagaaccccuggauggaggacaagacccccgucgagagcugggaggagauccccuaccugggcaagcgcgaggaccaguggugcgggagccugaucggccucaccucccgggcgacgugggccaagaacauccagaccgccaucaaccaggugcgcagccugaucgggaacgaggaguacaccgacuacaugccguccaugaagcgcuuccggcgcgaggaggaggaggccggcgugcugugguga

SEQ ID NO: 9690 - RNA, 9876 nt, Artificial Sequence
  derived and/or modified CDS sequence (opt1) from DENV-2__KC762677__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccacccacuuccagcgggugcugaucuucauccuccugaccgccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaagaccuggggcaaggcgaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuacugcgacagcaagcugauguccgccgccaucaaggacaaccgggcggugcacgccgacaugggguacuggaucgagagcgcccucaacgacaccuggaagaucgagaaggccuccuucaucgaggucaagagcugcuacuggcccaagucccacacccuguggagcaacggcgugcuggaguccgagaugaucauccccaagaacuucgccggccccgugagccagcacaacuaccgcccgggguaccacacccagaccgcgggccccuggcaccucgggcggcuggagauggacuucgacuucugcgagggcacgaccguggucgugaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggcccaugaaggagaaggaggagaaccucgugaacucccuggucacggccggccacgggcagaucgacaacuucagccugggcgugcucggcauggcccuguuccuggaggagaugcuccgcacccggguggggaccaagcacgcgauccugcuggucgccguguccuucgugacccucaucacgggcaacaugagcuuccgcgaccuggggcgcgucauggugauggugggcgccaccaugaccgacgacaucgggaugggcgucaccuaccuggcccuccuggccgcguucaaggugcggcccacguucgccgccggccugcuccugcgcaagcugaccuccaaggagcucaugaugaccaccaucgggaucgugcugcugagccaguccacgauccccgagaccauccucgagcugaccgacgcccuggcccucggcaugauggcgcugaagaucguccggaacauggagaaguaccagcuggccgugaccaucauggccauccucugcgucccgaacgccgugauccugcagaacgccuggaaggugagcugcacgacccuggcggucguguccgugagcccccuccugcugaccuccagccagcagaaggccgacuggaucccccucgcccugaccaucaaggggcugaaccccacggccaucuuccucaccacccugucccgcaccagcaagaagcgguccuggccgcugaacgaggcgaucauggccgucggcauggugagcauccucgccuccagccugcugaagaacgacauccccaugacgggcccccucguggccgggggccugcugaccgucugcuacgugcucaccgggcgcagcgccgaccuggagcuggagcgggcggccgacgugcgcugggaggagcaggccgagaucuccggcagcucccccauccucagcaucaccaucuccgaggacgggagcauguccaucaagaacgaggaggaggagcagacgcugaccauccugauccggaccggccuccuggucaucagcggccuguucccgguguccauccccaucaccgccgccgcgugguaccucugggaggugaagaagcagcgcgccgggguccugugggacgugcccagcccgccgcccgugggcaaggccgagcuggaggacggggccuaccggaucaagcagaagggcauccucggguacucccagaucggcgccggcgucuacaaggaggggaccuuccacacgauguggcacgugacccgcggcgcggugcugaugcacaaggggaagcggaucgagcccagcugggccgacgucaagaaggaccugaucuccuacggcgggggcuggaagcucgagggcgaguggaaggagggggaggagguccaggugcuggcccuggagcccggcaagaacccccgcgccguccagaccaagcccggccuguucaagaccaacacgggcaccaucggggccgugagccuggacuucucccccggcaccagcggcucccccaucguggacaagaaggggaaggucgugggccuguacgggaacggcguggucacccggagcggcacguacguguccgcgaucgcccagaccgagaaguccaucgaggacaaccccgagaucgaggacgacaucuuccgcaagaagcggcucaccaucauggaccugcaccccggggccggcaagaccaagcgcuaccugcccgccaucgugcgggaggcgaucaagcgcgggcugcggacgcucauccuggccccgacccgcgucguggccgccgagauggaggaggcccugcgcggccuccccauccgguaccagacccccgcgauccgcgccgagcacaccgggcgggagaucguggaccugaugugccacgccacguucaccaugcgccugcucagccccauccgggucccgaacuacaaccugaucaucauggacgaggcccacuucaccgaccccgccuccaucgcggcccgcggcuacaucagcacccggguggagaugggcgaggccgccgggaucuucaugacggccacgccgcccggcucccgcgacccguucccccagagcaacgcgcccaucauggacgaggagcgggagauccccgagcgcuccuggaacagcgggcacgagugggugaccgacuucaagggcaagaccgucugguucgugccguccaucaaggccgggaacgacaucgccgccugccugcggaagaacggcaagaaggugauccagcucagccgcaagacguucgacuucgaguacaucaagacccggaccaacgacugggacuucgucgugaccacggacaucuccgagaugggcgcgaacuucaaggccgagcgcgugaucgacccccggcgcugcaugaagcccgucauccugaccgacggggaggagcgggugauccuggccggccccaugccggugacccacagcuccgccgcccagcgccgggggcgcgucggccgcaaccccaagaacgagaacgaccaguacaucuacaugggggagccccucgagaacgacgaggacugcgcgcacuggaaggaggccaagaugcugcuggacaacaucaacacccccgagggcaucaucccgagcauguucgagcccgagcgggagaagguggacgccaucgacggcgaguaccgccuccgcggggaggcccgcaagacguucguggaccugaugcggcgcggcgaccugcccgucuggcucgccuaccggguggcggccgaggggaucaacuacgccgaccgccgguggugcuucgacggcgucaagaacaaccagauccuggaggagaacguggagguggagaucuggaccaaggagggggagcgcaagaagcugaagccgcgguggcucgacgcccgcaucuacuccgacccccuggcccugaaggaguucaaggaguucgcggccggccgcaagagccucacccugaaccugaucaccgagaugggccgccuccccacguucaugacccagaaggcccggaacgcccuggacaaccuggcgguccuccacaccgccgaggccgggggccgcgccuacaaccacgcccuguccgagcugcccgagacccucgagacgcugcugcuccugacccugcucgcgaccgugaccgggggcaucuuccuguuccugaugagcggcaaggggaucggcaagaugacccucgggaugugcugcaucaucacggccuccauccugcugugguacgcccagauccagccgcacuggaucgccgccagcaucauccucgaguucuuccugaucgugcugcucauccccgagcccgagaagcagcggacgccccaggacaaccagcugaccuacgucgugaucgcgauccugaccguggucgccgccacgauggccaacgagaugggcuuccucgagaagaccaagaaggacuucgggcugggcuccaucaccacccagcagccggagagcaacauccuggacaucgaccuccgccccgccagcgcguggacgcuguacgccguggccaccaccuucaucacccccaugcugcggcacuccaucgagaacagcuccgugaacgucagccucacggccaucgccaaccaggcgaccgugcugaugggccuggggaagggcuggccccucuccaagauggacaucggggugccgcugcuggccaucggcugcuacagccaggucaaccccaucacccucaccgccgcccugcugcuccugguggcgcacuacgccaucaucgggcccggccugcaggccaaggccacgcgcgaggcccagaagcgggcggccgccggcaucaugaagaaccccaccguggacgggaucaccgucaucgaccucgacccgauccccuacgaccccaaguucgagaagcagcugggccaggugaugcugcucgugcugugcgucacccaggugcugaugaugcgcacgaccugggcccucugcgaggcccugacccuggcgaccgggcccaucuccacgcucugggagggcaacccggggcgcuucuggaacaccaccaucgccgugagcauggccaacaucuuccggggcuccuaccuggccggcgccgggcuccucuucagcaucaugaagaacaccgcgaacacgcgccggggcaccgggaacaccggcgagacccugggcgagaaguggaagaaccgccugaacgcccucgggaaguccgaguuccagaucuacaagaaguccggcauccaggaggucgaccggacgcuggccaaggaggggaucaagcgcggcgagaccgaccaccacgccgugucccgggggagcgcgaagcugcgcugguucguggagcggaaccucgucacccccgagggcaaggugguggaccugggcugcgggcgcggcgggugguccuacuacugcggcgggcugaagaacgucaaggaggugaagggccucaccaagggcgggcccggccacgaggagcccaucccgaugagcacguacggguggaaccuggugcggcugcaguccggcgucgacguguucuucacgccgcccgagaagugcgacacccuccugugcgacaucggggagagcucccccaacccgaccguggaggccggccgcacccugcggguccucaaccugguggagaacuggcugaacaacaacacgcaguucugcaucaaggugcucaaccccuacaugcccagcgucaucgagaagauggaggcccugcagcgcaaguacggcggggcccuggugcggaacccgcugagccgcaacuccacccacgagauguacugggugagcaacgccuccggcaacaucgucagcuccgugaacaugaucagccggaugcucaucaaccgcuucaccaugcggcacaagaaggcgaccuacgagcccgacguggaccugggguccggcacgcgcaacaucgggaucgagagcgagauccccaaccuggacaucaucggcaagcgcaucgagaagaucaagcaggagcacgagaccuccuggcacuacgaccaggaccaccccuaccggaccugggccuaccacggcagcuacgagaacaagcagaccggguccgccagcuccauggucaacggcguggugcgccuccugacgaagccgugggacgucauccccauggugacccagauggccaugaccgacaccacgcccuucgggcagcagcggguguucaaggagaaggucgacacccgcacccaggagcccaaggagggcaccaagaagcugaugaagaucacggccgaguggcucuggaaggagcugggcaagaagaagaccccgcggaugugcacccgcaaggaguucacccggaaggugcgcagcaacgcggcccugggggccaucuucacggacgagaacaaguggaaguccgcccgggaggccgucgaggacagcggcuucugggagcucguggacaaggagcgcaaccugcaccuggaggggaagugcgagaccugcguguacaacaugaugggcaagcgggagaagaagcucggggaguucggcaaggcgaagggcucccgcgccaucugguacauguggcugggggcccgguuccuggaguucgaggcccucggcuuccugaacgaggaccacugguucagccgcgagaacucccugagcggggucgagggcgaggggcuccacaagcugggcuacauccugcgggacgugagcaagaaggagggcggggcgauguacgccgacgacaccgccggcugggacacccgcaucacgcucgaggaccugaagaacgaggagauggugaccaaccacauggagggggagcacaagaagcuggccgaggccaucuucaagcucaccuaccagaacaaggucgugcgggugcagcgccccacgccccggggcacggucauggacaucaucucccgccgggaccagcgcgggagcggccagguggugaccuacggccugaacaccuucaccaacauggaggcgcagcugauccgccagauggagggggagggcgucuucaaguccauccagcagcucacggugaccgaggagaucgccgugaagaacuggcugguccggguggggcgcgagcggcugagccgcauggccaucuccggcgacgacugcguggucaagccccucgacgaccgguucgccagcgcccugaccgcgcugaacgacaugggcaaggugcgcaaggacauccagcagugggagccgucccggggguggaacgacuggacccaggugcccuucugcagccaccacuuccacgagcucaucaugaaggacggccgcguccugguggugcccugccggaaccaggacgagcugaucgggcgcgcccggaucucccagggcgccggguggagccuccgcgagacggccugccugggcaaguccuacgcccagauguggagccugauguacuuccaccggcgcgaccuccggcuggcggccaacgccaucugcuccgccguccccagccacugggugccgaccucccgcaccaccuggagcauccacgccacccacgaguggaugacgaccgaggacaugcugaccguguggaaccgggucuggauccaggagaaccccuggauggaggacaagacccccguggaguccugggaggagauccccuaccucggcaagcgcgaggaccaguggugcgggagccugaucggccugacgagccgggcgaccugggccaagaacauccagaccgccaucaaccaggugcgcucccucaucgggaacgaggaguacaccgacuacaugccgagcaugaagcgcuuccggcgcgaggaggaggaggccggcguccugugguga

SEQ ID NO: 9691 - RNA, 9876 nt, Artificial Sequence
  derived and/or modified CDS sequence (opt1) from DENV-2__KC762668__SS-prME
accgccggcaucaucaucauggugauccccaccgucauggccuuccaccugaccacccgcaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggucaccuacgggaccugcaccgccaccggcgagcaccggcgcgagaagcggagcguggcccuggugccccacgucggcauggggcuggagacccgcaccgagaccuggauguccagcgagggcgccuggaagcacgcccagcggaucgagaccugggugcuccgccacccgggguucaccaucauggcggccauccuggccuacaccaucggcaccaccuacuuccagcgggugcugaucuucauccuccugaccgccgucgcgcccuccaugaccaugcgcugcaucgggaucagcaaccgggacuucguggagggcguguccggcgggagcugggucgacaucgugcuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgucugcaagcacagcaugguggaccggggcuggggcaacgggugcggccuguucgggaagggcgggaucgugacgugcgccauguucacgugcaagaagaacauggagggcaagaucguccagcccgagaaccucgaguacaccaucgugaucacgccccacuccggcgaggagaacgccguggggaacgacacgggcaagcacgggaaggagaucaagaucaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggagguggaggacuacggguucggcguguucaccaccaacaucuggcucaagcugaaggagcgccaggacgucuucugcgacagcaagcugauguccgccgcgaucaaggacaaccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcaccacgguggucgugaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggugaacucccuggucaccgccggccacgggcagaucgacaacuucagccucggcgugcugggcauggcgcuguuccucgaggagaugcugcgcacgcggguggggaccaagcacgccauccugcucgucgccguguccuucgugacccugaucaccggcaacaugagcuuccgcgaccuggggcgcgucauggugauggugggcgccacgaugaccgacgacaucgggaugggcgucaccuaccucgcccugcuggcggccuucaaggugcggcccaccuucgccgccggccuccugcugcgcaagcucacguccaaggagcugaugaugaccaccaucgggaucgugcugcucagccaguccaccauccccgagacgauccuggagcugaccgacgcccucgcgcugggcaugaugguccugaagaucgugcggaacauggagaaguaccagcucgccgucaccaucauggccauccugugcgugccgaacgccgugauccugcagaacgccuggaaggucagcugcaccacgcucgcggugguguccgucagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgugggcauggugagcauccuggccuccagccugcucaagaacgacauccccaugaccggcccccuggucgccgggggccugcucacggugugcuacgugcugaccgggcgcagcgccgaccuggagcucgagcgggcggccgacguccgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccgguguccauccccaucaccgccgccgcgugguaccugugggaggucaagaagcagcgcgccggggugcugugggacgugcccagcccgccgcccgucggcaaggccgagcucgaggacggggccuaccggaucaagcagaagggcauccugggguacucccagaucggcgccggcguguacaaggaggggaccuuccacaccauguggcacgugacgcgcggcgcgguccugaugcacaaggggaagcggaucgagcccagcugggccgacgugaagaaggaccucaucuccuacggcgggggcuggaagcuggagggcgaguggaaggagggggaggaggugcagguccuggcccucgagcccggcaagaacccccgcgccgugcagaccaagcccgggcuguucaagaccaacaccggcaucaucggggccgugagccuggacuucucccccggcacgagcggcucccccaucgucgacaagaaggggaagguggugggccucuacgggaacggcgucgugacccggagcggcaccuacguguccgcgaucgcccagaccgagaaguccaucgaggacaaccccgagaucgaggacgacaucuuccgcaagaagcggcugacgaucauggaccugcaccccggggccggcaagaccaagcgcuaccugcccgccaucguccgggaggcgaucaagcgcgggcuccggacccugauccuggccccgacccgcgugguggccgccgagauggaggaggcccuccgcggccugcccauccgguaccagacgcccgcgauccgcgccgagcacaccgggcgggagaucgucgaccugaugugccacgccaccuucaccaugcgccuccugagccccauccgggugccgaacuacaaccugaucaucauggacgaggcccacuucacggaccccgccuccaucgcggcccgcggcuacaucagcacccggguggagaugggcgaggccgccgggaucuucaugaccgccacgccgcccggcucccgcgacccguucccccagagcaacgcgcccaucauggacgaggagcgggagauccccgagcgcuccuggaacagcgggcacgagugggucacggacuucaagggcaagaccgugugguucgugccguccaucaaggccgggaacgacaucgccgccugccuccggaagaacggcaagaaggucauccagcugagccgcaagaccuucgacuucgaguacaucaagacccggacgaacgacugggacuucguggugaccaccgacaucuccgagaugggcgcgaacuucaaggccgagcgcgucaucgacccccggcgcugcaugaagcccgugauccugaccgacggggaggagcgggugauccucgccggccccaugccggucacgcacagcuccgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccgagcauguucgagcccgagcgggagaagguggacgccaucgacggcgaguaccgccugcgcggggaggcccgcaagaccuucgucgaccugaugcggcgcggcgaccuccccguguggcuggccuaccgggucgcggccgaggggaucaacuacgccgaccgccgguggugcuucgacggcgugaagaacaaccagauccuggaggagaacguggaggucgagaucuggaccaaggagggggagcgcaagaagcucaagccgcgguggcuggacgcccgcaucuacuccgacccccuggcccucaaggaguucaaggaguucgcggccggccgcaagagccugacgcugaaccucaucaccgagaugggccgccugcccaccuucaugacccagaaggcccggaacgcccuggacaaccucgcggugcugcacacggccgaggccgggggccgcgccuacaaccacgcccuguccgagcuccccgagacccuggagacccugcuccugcugacccuccuggcgacggugaccgggggcaucuuccuguuccucaugagcggcaaggggaucggcaagaugacccuggggaugugcugcaucaucaccgccuccauccugcucugguacgcccagauccagccgcacuggaucgccgccagcaucauccuggaguucuuccugaucguccuccugauccccgagcccgagaagcagcggacgccccaggacaaccagcugacguacguggugaucgcgauccucaccgucguggccgccaccauggccaacgagaugggcuuccuggagaagaccaagaaggacuucgggcugggcuccaucacgacccagcagcucgagagcaacauccuggacaucgaccugcgcccggccagcgcguggacccucuacgccguggccaccacguucaucacccccaugcugcggcacuccaucgagaacagcuccgucaacgugagccugaccgccaucgccaaccaggcgaccgugcucaugggccuggggaagggcuggccccuguccaagauggacaucggggucccccuccuggccaucggcugcuacagccaggugaacccgaucacgcugaccgccgcccuccugcugcucguggcgcacuacgccaucaucgggcccggccugcaggccaaggccacccgcgaggcccagaagcgggcggccgccggcaucaugaagaaccccaccgucgacgggaucacggugaucgaccuggaccccaucccguacgaccccaaguucgagaagcagcucggccaggugaugcugcugguccucugcgugacccaggugcugaugaugcgcaccaccugggcccugugcgaggcccucacgcuggcgaccgggcccaucuccacccugugggagggcaaccccgggcgcuucuggaacaccacgaucgccgucagcauggccaacaucuuccggggcuccuaccucgccggcgccgggcugcuguucagcaucaugaagaacaccgcgaacacccgccggggcaccgggaacacgggcgagacccucggcgagaaguggaagaaccgccugaacgcccuggggaaguccgaguuccagaucuacaagaaguccggcauccaggagguggaccggacccucgccaaggaggggaucaagcgcggcgagaccgaccaccacgccgugucccgggggagcgcgaagcugcgcugguucgucgagcggaaccuggugacgccggagggcaagguggucgaccucggcugcgggcgcggcgggugguccuacuacugcggcgggcugaagaacgugaaggaggugaagggccugaccaagggcgggcccggccacgaggagcccauccccaugagcaccuacggguggaaccucguccggcugcaguccggcguggacguguucuucaccccgcccgagaagugcgacacgcugcucugcgacaucggggagagcucccccaaccccaccgucgaggccggccgcacccugcgggugcugaaccucguggagaacuggcugaacaacaacacccaguucugcaucaagguccugaacccguacaugcccagcgugaucgagaagauggaggcccugcagcgcaaguacggcggggcccucgugcggaacccccugagccgcaacuccacccacgagauguacugggucagcaacgccuccggcaacaucgugagcuccgugaacaugaucagccggaugcugaucaaccgcuucacgaugcggcacaagaaggcgaccuacgagccggacgucgaccucggguccggcacccgcaacaucgggaucgagagcgagacccccaaccuggacaucaucggcaagcgcaucgagaagaucaagcaggagcacgagacguccuggcacuacgaccaggaccaccccuacaagaccugggccuaccacggcagcuacgagaccaagcagaccggguccgccagcuccauggugaacggcgugguccggcugcucacgaagcccugggacgugaucccgauggugacccagauggccaugaccgacaccacgcccuucgggcagcagcgcgucuucaaggagaagguggacacccggacccaggagcccaaggagggcaccaagaagcugaugaagaucacggccgaguggcuguggaaggagcucggcaagaagaagacgccccggaugugcacccgggaggaguucacccgcaagguccggagcaacgcggcccugggggccaucuucacggacgagaacaaguggaaguccgcccgcgaggccguggaggacagcggcuucugggagcugguggacaaggagcggaaccuccaccuggaggggaagugcgagaccugcgucuacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggagaacucccugagcgggguggagggcgaggggcugcacaagcucggcuacauccugcgcgacgugagcaagaaggagggcggggcgauguacgccgacgacaccgccggcugggacacccggaucacgcuggaggaccucaagaacgaggagauggucaccaaccacauggagggggagcacaagcgccuggccgaggccaucuuccggcugaccuaccagaacaagguggugcgcguccagcggccgacgccccggggcacggugauggacaucaucucccggcgcgaccagcgcgggagcggccagguggucaccuacggccucaacaccuucaccaacauggaggcgcagcugauccggcagauggagggggagggcguguucaaguccauccagcaccugacggugaccgaggagaucgccgucaagaacuggcucgcccgcguggggcgggagcgccugagccggauggccaucuccggcgacgacugcguggucaagccccuggacgaccgcuucgccagcgcgcucaccgcccugaacgacaugggcaaggugcggaaggacauccagcagugggagcccucccgcggguggaacgacuggacccaggugccguucugcagccaccacuuccacgagcugaucaugaaggacggccggguccucguggugcccugccgcaaccaggacgagcugaucgggcgggcccgcaucucccagggcgccggguggagccugcgggagacggccugccucggcaaguccuacgcgcagauguggagccugauguacuuccaccgccgggaccugcgccucgccgccaacgccaucugcuccgccguccccagccacugggugcccaccucccggaccaccuggagcauccacgcgacccacgaguggaugacgaccgaggacaugcugaccguguggaaccgcgucuggauccaggagaacccguggauggaggacaagacccccguggaguccugggaggagauccccuaccugggcaagcgggaggaccaguggugcgggagccucaucggccugacgagccgcgccaccugggccaagaacauccagaccgccaucaaccaggugcgcucccugaucgggaacgaggaguacaccgacuacaugcccagcaugaagcgguuccgccgggaggaggaggaggcgggcguccucugguga

SEQ ID NO: 9692 - RNA, 9876 nt, Artificial Sequence
  derived and/or modified CDS sequence (opt1) from DENV-2__KC762678__SS-prME
accgccggcaucaucaucaugaugauccccaccgucauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggguccuccgccaccccggguucaccaucauggcggccauccuggccuacaccaucggcaccaccuacuuccagcggauccugaucuucauccuccugacggccgugacccccuccaugaccaugcgcugcaucgggaucagcaaccgggacuucguggagggcgucuccggcgggagcuggguggacaucgugcuggagcacggcuccugcgucaccacgauggcgaagaacaagcccacccucgacuucgagcugaucaagaccgaggccaagcaccccgccacccugcgcaaguacugcaucgaggccaagcucacgaacaccaccaccgccagccggugcccgacgcagggggagcccucccugaacgaggagcaggacaagcgcuucgugugcaagcacagcaugguggaccggggcuggggcaacgggugcggccuguucgggaagggcgggaucgugaccugcgcgauguucacgugcaagaagaacauggagggcaagaucgugcagcccgagaaccucgaguacaccaucgugaucacgccccacuccggcgaggagaacgccgucgggaacgacaccggcaagcacgggaaggagaucaaggugaccccgcagagcuccaucaccgaggccgagcugaccggcuacgggacggugaccauggagugcagcccccgcaccggccuggacuucaacgagaugguccuccugcagauggagaacaaggccuggcuggugcaccggcagugguuccucgaccugccccugcccuggcucccgggcgccgacacccagggguccaacuggauccagaaggagacgcuggugaccuucaagaacccccacgcgaagaagcaggacgucgugguccugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaagguggugaaggagaucgccgagacccagcacggcacgaucgucauccgcgugcaguacgagggggacggcagccccugcaagauccccuucgagaucauggaccuggagaagcggcacgugcugggccgccucaucaccgucaacccgaucgugaccgagaaggacucccccgugaacaucgaggcggagccgcccuucggggacagcuacaucaucaucggcgucgagccggggcagcugaagcuguccugguucaagaagggcagcuccaucgggcagauguucgagaccacgaugcgcggcgccaagcggauggccauccucggcgacaccgccugggacuucgggagccugggcgggguguucaccuccaucggcaaggcccugcaccagguguucggggcgaucuacggcgccgccuucagcggcgucuccuggaccaugaagauccucaucgggguggugaucacguggaucggcaugaacagccgcuccaccagccuguccgucagccuggugcuggugggggucgugacccucuaccugggcgugaugguccaggccgacuccgggugcguggugagcuggaagaacaaggagcugaagugcggcagcggcaucuucaucaccgacaacguccacacguggaccgagcaguacaaguuccagcccgagucccccagcaagcucgcguccgccauccagaaggcccacgaggaggggaucugcggcauccggagcgugacccgccuggagaaccugauguggaagcagaucacccccgagcucaaccacauccuguccgagaacgaggugaagcugacgaucaugaccggggacaucaagggcaucaugcaggccgggaagcggagccuccgcccgcagcccaccgagcugaaguacuccuggaagaccuggggcaaggccaagaugcugagcacggagcuccacaaccacaccuuccugaucgacggccccgagaccgcggagugcccgaacgccaaccgggccuggaacucccuggaggucgaggacuacggguucggcguguucaccacgaacaucuggcucaagcugaaggagcgccaggacgccuucugcgacagcaagcugauguccgccgcgaucaaggacaaccgggccgugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcacgaccgucguggugaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggucaacucccuggugacggccggccacgggcagaucgacaacuucagccucggcgugcugggcauggcgcuguuccucgaggagaugcugcgcacccgggucgggaccaagcacgccauccugcucguggccguguccuucgucacccugaucacgggcaacaugagcuuccgcgaccuggggcgcgugauggugauggucggcgccaccaugaccgacgacaucgggaucggcgugaccuaccucgcccugcuggcggccuucaaggugcggcccacguucgccgccggccuccugcugcgcaagcucaccuccaaggagcugaugaugaccaccaucgggaucacgcugcucagccaguccaccauccccgagaccauccuggagcugaccgacgcccucgcgcugggcaugaugguccugaagaucgugcggaacauggagaaguaccagcucgccgugacgaucauggccauccugugcgucccgaacgccgugauccugcagaacgccuggaaggucagcugcaccacccucgcggugguguccgucagcccccugcugcucaccuccagccagcagaaggccgacuggaucccccuggcccugacgaucaaggggcucaaccccaccgccaucuuccugaccacccugucccgcacgagcaagaagcgguccuggccgcucaacgaggcgaucauggccgugggcauggugagcauccuggccuccagccugcucaagaacgacauccccaugaccggcccccuggucgccgggggccugcucaccgugugcuacgugcugaccgggcgcagcgccgaccuggagcucgagcgggcggccgacguccgcugggaggagcaggccgagaucuccggcagcucccccauccugagcaucacgaucuccgaggacgggagcauguccaucaagaacgaggaggaggagcagacccugaccauccucauccggaccggccugcuggugaucagcggccucuucccgguguccauccccaucaccgccgccgcgugguaccugugggaggucaagaagcagcgcgccggggugcugugggacgugcccagcccgccgcccgucggcaaggccgagcucgaggacggggccuaccggaucaagcagaagggcauccugggguacucccagaucggcgccggcguguacaaggaggggacguuccacaccauguggcacgugacccgcggcgcgguccugaugcacaaggggaagcggaucgagcccagcugggccgacgugaagaaggaccucaucuccuacggcgggggcuggaagcuggagggcgaguggaaggagggggaggaggugcagguccuggcccucgagcccggcaagaacccccgcgccgugcagaccaagcccgggcuguucaagacgagcaccggcaccaucggggccgugucccuggacuucagccccggcaccuccggcagccccaucgucgacaagaaggggaagguggugggccucuacgggaacggcgucgugacgcgguccggcaccuacgugagcgcgaucgcccagaccgagaaguccaucgaggacaaccccgagaucgaggacgacaucuuccgcaagaagcggcugaccaucauggaccugcaccccggggccggcaagacgaagcgcuaccugcccgccaucguccgggaggcgaucaagcgcgggcuccggacccugauccuggccccgacccgcgugguggccgccgagauggaggaggcccuccgcggccugcccauccgguaccagacccccgcgauccgcgccgagcacacggggcgggagaucgucgaccugaugugccacgccaccuucaccaugcgccuccugucccccauccgggugccgaacuacaaccugaucaucauggacgaggcccacuucaccgaccccgccagcaucgcggcccgcggcuacaucuccacgcggguggagaugggcgaggccgccgggaucuucaugaccgccacgccgcccggcagccgcgacccguucccccaguccaacgcgcccaucauggacgaggagcgggagauccccgagcgcagcuggaacuccgggcacgagugggucaccgacuucaagggcaagacggugugguucgugccgagcaucaaggccgggaacgacaucgccgccugccuccggaagaacggcaagaaggucauccagcugucccgcaagaccuucgacagcgaguacaucaagacccggaccaacgacugggacuucguggugacgaccgacaucuccgagaugggcgcgaacuucaaggccgagcgcgucaucgacccccggcgcugcaugaagcccgugauccugaccgacggggaggagcgggugauccucgccggccccaugccggucacccacagcuccgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacgcccgagggcaucaucccgagcauguucgagcccgagcgggagaagguggacgccaucgacggcgaguaccgccugcgcggggaggcccgcaagaccuucgucgaccugaugcggcgcggcgaccuccccguguggcuggccuaccggguggcggccgaggggaucaacuacgccgaccgccgguggugcuucgacggcgucaagaacaaccagauccuggaggagaacguggaggucgagaucuggaccaaggagggggagcgcaagaagcucaagccgcgguggcuggacgcccgcaucuacuccgacccccuggcccucaaggaguucaaggaguucgcggccggccgcaagagccugacccugaaccucaucacggagaugggccgccugcccaccuucaugacccagaaggugcggaacgcccuggacaaccucgccgugcugcacaccgcggaggccgggggccgcgccuacaaccacgcccuguccgagcuccccgagacgcuggagacccugcuccugcugacccuccuggccaccgucaccgggggcaucuuccuguuccucaugagcggcaagggggugggcaagaugacgcuggggaugugcugcaucaucaccgcguccauccugcucugguacgcccagauccagccgcacuggaucgccgccagcaucauccuggaguucuuccugaucgugcuccugauccccgagcccgagaagcagcggacgccccaggacaaccagcugaccuacgucgugaucgccauccucacgguggucgcggccaccauggccaacgagaugggcuuccuggagaagaccaagaaggacuucgggcugggcagcaucaccacgcagcagccggaguccaacauccucgacaucgaccugcgccccgccagcgccuggacccuguacgcgguggccaccaccuucaucacgcccaugcuccggcacuccaucgagaacagcuccgugaacgucagccugaccgccaucgccaaccaggccaccgugcugaugggccucgggaagggcuggccccuguccaagauggacaucggggugccgcugcucgcgaucggcugcuacagccaggucaaccccaucacccugacggccgcccugcuccugcugguggcccacuacgcgaucaucgggcccggccuccaggccaaggccacccgcgaggcccagaagcggaccgccgcgggcaucaugaagaaccccaccguggacgggaucacggucaucgaccuggacccgauccccuacgaccccaaguucgagaagcagcugggccaggugaugcuccuggugcugugcgucacccaggugcucaugaugcgcaccaccugggcccugugcgaggcccugacgcucgccaccgggcccaucuccacccugugggagggcaacccggggcgcuucuggaacaccacgaucgccgugagcauggcgaacaucuuccggggcuccuaccuggccggcgccgggcuccuguucagcaucaugaagaacaccgccaacacccgccggggcaccgggaacacgggcgagacccugggcgagaaguggaagaaccgccucaacgcccuggggaaguccgaguuccagaucuacaagaaguccggcauccaggaggucgaccggacccuggcgaaggaggggaucaagcgcggcgagaccgaccaccacgccgugucccgggggagcgccaagcuccgcugguucguggagcggaaccuggucacgcccgagggcaaggugguggaccugggcugcgggcgcggcgggugguccuacuacugcggcgggcucaagaacgucaaggaggugaagggccugaccaagggcgggcccggccacgaggagcccaucccgaugagcaccuacggguggaaccuggugcggcuccaguccggcgucgacguguucuucacgccgcccgagaagugcgacacccugcugugcgacaucggggagagcagccccaacccgacgguggaggccggccgcacccuccggguccugaaccugguggagaacuggcucaacaacaacacccaguucugcaucaaggugcugucccccuacaugcccagcgucaucgagaagauggaggcgcugcagcgcaaguacggcggggcccuggugcggaacccgcucucccgcaacagcacccacgagauguacuggguguccaacgccagcggcaacaucgucuccagcgugaacaugaucucccggaugcugaucaaccgcuucacgaugcggcacaagaaggccaccuacgagcccgacguggaccuggggagcggcacccgcaacaucgggaucgaguccgagacccccaaccucgacaucaucggcaagcgcaucgagaagaucaagcaggagcacgagacgagcuggcacuacgaccaggaccaccccuacaagaccugggccuaccacggcuccuacgagaccaagcagaccgggagcgcguccagcauggucaacggcguggugcggcugcugacgaagccgugggacgucauccccauggugacccagauggccaugaccgacaccacgcccuucgggcagcagcgcguguucaaggagaaggucgacacccggacccaggagcccaaggagggcaccaagaagcucaugaagaucacggccgaguggcuguggaaggagcugggcaagaagaagaccccgcgcaugugcacccgggaggaguucacccgcaaggugcgguccaacgccgcccucggggcgaucuucacggacgagaacaaguggaaguccgcccgcgaggccgucgaggacuccggcuucugggagcugguggacaaggagcggaaccugcaccucgaggggaagugcgagaccugcguguacaacaugaugggcaagcgcgagaagaagcugggggaguucggcaaggccaagggcagccgggccaucugguacauguggcugggggcgcgcuuccucgaguucgaggcccugggcuuccugaacgaggaccacugguucagccgggagaacucccucagcggggucgagggcgaggggcugcacaagcugggcuacauccuccgcgacguguccaagaaggagggcggggccauguacgccgacgacaccgcgggcugggacacccggaucacgcuggaggaccugaagaacgaggagauggugaccaaccacauggagggggagcacaagaagcucgccgaggccaucuucaagcugaccuaccagaacaaggucgugcgcgugcagcggcccacgccccggggcacggucauggacaucaucagccggcgcgaccagcggggguccggccagguggugaccuacggccugaacaccuucaccaacauggaggcccagcucauccgccagauggagggggagggcgucuucaagagcauccagcagcugacggugaccgaggagaucgccgugaagaacuggcuggucaccguggggcgcgagcggcucucccgcauggcgaucagcggcgacgacugcguggucaagccccuggacgaccgguucgccuccgcccugaccgcccucaacgacaugggcaaggugcgcaaggacauccagcagugggagccgagccggggguggaacgacuggacccaggugcccuucugcucccaccacuuccacgagcugaucaugaaggacggccgcguccugguggugcccugccggaaccaggacgagcucaucgggcgcgcccggaucagccagggcgcgggguggucccugcgcgagacggccugccugggcaagagcuacgcccagauguggucccucauguacuuccaccggcgcgaccugcggcuggccgccaacgcgaucugcagcgccguccccucccacugggugccgaccagccgcaccaccuggagcauccacgccacgcacgaguggaugaccaccgaggacaugcucaccguguggaaccgggucuggauccaggagaaccccuggauggaggacaagacgcccguggaguccugggaggagauccccuaccugggcaagcgcgaggaccaguggugcgggagccugaucggccucaccucccgggccaccugggccaagaacauccagaccgcgaucaaccaggugcgcagccugaucgggaacgaggaguacacggacuacaugccguccaugaagcgguuccgccgcgaggaggaggaggccggcguccugugguga

SEQ ID NO: 9693 - RNA, 9876 nt, Artificial Sequence
  derived and/or modified CDS sequence (opt1) from DENV-2__KC762679__SS-prME
accgccggcaucaucaucaugaugauccccaccgugauggccuuccaccugaccacccggaacggggagccccacaugaucgucagccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcgguacguccugggccgccucaucacggugaacccgaucgugaccgagaaggacucccccgucaacaucgaggccgagccgcccuucggggacagcuacaucaucaucggcguggagccggggcagcugaagcugaacugguucaagaagggcuccagcaucgggcagauguucgagaccaccaugcgcggcgccaagcggauggccauccucggcgacacggccugggacuucgggucccugggcgggguguucaccagcaucggcaaggcgcugcaccaggucuucggggccaucuacggcgccgccuucuccggcgugagcuggaccaugaagauccucaucgggguggucaucaccuggaucggcaugaacucccgcagcacgucccugagcgugucccuggugcuggucgggguggugacccucuaccugggcgucauggugcaggcggacagcgggugcguggucuccuggaagaacaaggagcugaagugcggcagcggcaucuucaucaccgacaacgugcacaccuggacggagcaguacaaguuccagcccgagagccccuccaagcucgccagcgccauccagaaggcccacgaggaggggaucugcggcauccgguccgugacccgccuggagaaccugauguggaagcagaucacccccgagcucaaccacauccugagcgagaacgaggucaagcugaccaucaugacgggggacaucaagggcaucaugcaggccgggaagcggucccuccgcccgcagcccaccgagcugaaguacagcuggaaggcguggggcaaggccaagaugcuguccaccgagcuccacaaccacaccuuccugaucgacggccccgagacggccgagugcccgaacaccaaccgggccuggaacagccuggagguggaggacuacggguucggcguguucaccaccaacaucuggcucaagcugaaggagcgccaggacgucuucugcgacuccaagcugaugagcgccgcgaucaaggacucccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcaccacgguggucgugaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggugaacucccuggucaccgccggccacgggcagaucgacaacuucagccucggcgugcugggcauggcgcuguuccucgaggagaugcugcgcacgcggguggggaccaagcacgccauccugcucgucgccguguccuucgugacccugaucaccggcaacaugagcuuccgcgaccuggggcgcgucauggugauggugggcgccacgaugaccgacgacaucgggaugggcgucaccuaccucgcccugcuggcggccuucaaggugcggcccaccuucgccgccggccuccugcugcgcaagcucacguccaaggagcugaugaugaccaccaucgggaucgugcugcucagccaggccaccauccccgagacgauccuggagcugaccgacgcgcucgcccugggcaugaugguccugaagaucgugcggaacauggagaaguaccagcucgccgucaccaucauggccauccugugcgugccgaacgccgugauccugcagaacgcguggaaggucuccugcaccacgcucgccguggugagcgucagcccccugcugcucaccagcucccagcagaaggccgacuggaucccccuggcccugaccaucaaggggcucaaccccaccgcgaucuuccugacgacccugagccgcaccuccaagaagcggagcuggccgcucaacgaggccaucauggccgugggcaugguguccauccuggccagcucccugcucaagaacgacauccccaugaccggcccccuggucgccgggggccugcucacggugugcuacgugcugaccgggcgcagcgcggaccuggagcucgagcgggccgccgacguccgcugggaggagcaggccgagaucagcggcuccagccccauccuguccaucaccaucagcgaggacggguccaugagcaucaagaacgaggaggaggagcagacccugacgauccucauccggaccggccugcuggugaucuccggccucuucccggugagcauccccaucaccgccgcggccugguaccugugggaggucaagaagcagcgcgccggggugcugugggacgugcccagcccgccgcccgucggcaaggccgagcucgaggacggggccuaccggaucaagcagaagggcauccugggguacagccagaucggcgcgggcguguacaaggaggggaccuuccacaccauguggcacgugacgcgcggcgccguccugaugcacaaggggaagcggaucgagcccuccugggccgacgugaagaaggaccucaucagcuacggcgggggcuggaagcuggagggcgaguggaaggagggggaggaggugcagguccuggcccucgagcccggcaagaacccccgcgccgugcagaccaagcccgggcuguucaagaccaacaccggcacgaucggggcggugucccuggacuucagccccggcaccuccggcagccccaucgucgacaagaaggggaagguggugggccucuacgggaacggcgucgugacccgguccggcaccuacgugagcgccaucgcccagacggagaaguccaucgaggacaaccccgagaucgaggacgacaucuuccgcaagaagcggcugaccaucauggaccugcaccccggggccggcaagaccaagcgcuaccugcccgcgaucguccgggaggccaucaagcgcgggcuccggacccugauccuggccccgacgcgcgugguggccgccgagauggaggaggcgcuccgcggccugcccauccgguaccagacccccgccauccgcgccgagcacaccgggcgggagaucgucgaccugaugugccacgccaccuucacgaugcgccuccugagccccauccgggugccgaacuacaaccugaucaucauggacgaggcccacuucaccgaccccgcgagcaucgccgcccgcggcuacaucuccacccggguggagaugggcgaggccgccgggaucuucaugaccgcgacgccgcccggcagccgcgacccguucccccaguccaacgcccccaucauggacgaggagcgggagauccccgagcgcagcuggaacuccgggcacgagugggucaccgacuucaagggcaagaccgugugguucgugccgagcaucaaggccgggaacgacaucgccgcgugccuccggaagaacggcaagaaggucauccagcugucccgcaagaccuucgacagcgaguacaucaagacgcggaccaacgacugggacuucguggugaccaccgacaucuccgagaugggcgccaacuucaaggccgagcgcgucaucgacccccggcgcugcaugaagcccgugauccugacggacggggaggagcgggugauccucgccggccccaugccggucacccacagcuccgccgcgcagcgccgggggcgcgugggccgcaaccccaagaacgagaacgaccaguacaucuacaugggggagccccuggagaacgacgaggacugcgcccacuggaaggaggccaagaugcugcucgacaacaucaacacccccgagggcaucaucccgagcauguucgagcccgagcgggagaagguggacgccaucgacggcgaguaccgccugcgcggggaggcccgcaagaccuucgucgaccugaugcggcgcggcgaccuccccguguggcuggcguaccgggucgccgccgaggggaucaacuacgccgaccgccgguggugcuucgacggcgugaagaacaaccagauccuggaggagaacguggaggucgagaucuggacgaaggagggggagcgcaagaagcucaagccgcgguggcuggacgcccgcaucuacuccgacccccuggcgcucaaggaguucaaggaguucgccgccggccggaagucccugacccugaaccucaucaccgagaugggccgccugcccaccuucaugacgcagaaggcccggaacgcgcuggacaaccucgccgugcugcacaccgccgaggccgggggccgcgccuacaaccacgcgcuguccgagcuccccgagacccuggagacccugcuccugcugacgcuccuggccaccgugaccgggggcaucuuccuguuccucaugagcggcaaggggaucggcaagaugacccuggggaugugcugcaucaucaccgccuccauccugcucugguacgcccagauccagccgcacuggaucgccgcgagcaucauccuggaguucuuccugaucguccuccugauccccgagcccgagaagcagcggacgccccaggacaaccagcugaccuacguggugaucgccauccucaccgucguggccgccaccauggccaacgagaugggcuuccuggagaagacgaagaaggacuucgggcugggcuccaucaccacccagcagccggagagcaacauccucgacaucgaccugcgccccgcgagcgccuggacccuguacgccguggccacgaccuucaucacccccaugcuccggcacuccaucgagaacagcuccgucaacgugagccugaccgccaucgcgaaccaggccacggugcugaugggccucgggaagggcuggccccuguccaagauggacaucggggucccgcugcucgccaucggcugcuacagccaggugaaccccaucacccugaccgccgcgcugcuccugcugguggcccacuacgccaucaucgggcccggccuccaggccaaggccacccgcgaggcgcagaagcgggccgccgccggcaucaugaagaaccccacggucgacgggaucaccgugaucgaccuggacccgauccccuacgaccccaaguucgagaagcagcugggccaggugaugcuccugguccugugcgugacccaggugcucaugaugcgcaccacgugggcccugugcgaggcgcugacccucgccaccgggcccaucuccacccugugggagggcaacccggggcgcuucuggaacacgaccaucgccgucagcauggccaacaucuuccggggcuccuaccuggccggcgcggggcuccuguucagcaucaugaagaacaccgccaacacccgccggggcacggggaacaccggcgagacccugggcgagaaguggaagaaccgccucaacgcccuggggaaguccgaguuccagaucuacaagaaguccggcauccaggagguggaccggacccuggccaaggaggggaucaagcgcggcgagacggaccaccacgcggugucccgggggagcgccaagcuccgcugguucgucgagcggaaccuggugacccccgagggcaagguggucgaccugggcugcgggcgcggcgggugguccuacuacugcggcgggcucaagaacgugaaggaggugaagggccugaccaagggcgggcccggccacgaggagcccaucccgaugagcaccuacggguggaaccugguccggcuccaguccggcguggacguguucuucacgccgcccgagaagugcgacacccugcugugcgacaucggggagagcucccccaacccgaccgucgaggccggccgcacccuccgggugcugaaccugguggagaacuggcucaacaacaacacccaguucugcaucaagguccugaaccccuacaugcccagcgugaucgagaagauggaggcccugcagcgcaaguacggcggggcccuggugcggaacccgcucagccgcaacuccacgcacgagauguacugggucagcaacgcguccggcaacaucgugagcuccgugaacaugaucagccggaugcugaucaaccgcuucaccaugcggcacaagaaggccaccuacgagcccgacgucgaccugggguccggcacccgcaacaucgggaucgagagcgagacgcccaaccucgacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgugguccggcugcugaccaagccgugggacgugauccccauggugacccagauggccaugaccgacacgacccccuucgggcagcagcgcgucuucaaggagaagguggacacccggacccaggagcccaaggagggcacgaagaagcucaugaagaucaccgcggaguggcuguggaaggagcugggcaagaagaagaccccgcgcaugugcacccgggaggaguucacgcgcaagguccggagcaacgccgcccucggggccaucuucaccgacgagaacaaguggaaguccgcccgcgaggcgguggaggacagcggcuucugggagcugguggacaaggagcggaaccugcaccucgaggggaagugcgagaccugcgucuacaacaugaugggcaagcgcgagaagaagcugggggaguucggcaaggccaagggcucccgggccaucugguacauguggcugggggcccgcuuccucgaguucgaggcgcugggcuuccugaacgaggaccacugguucagccgggagaacucccucagcgggguggagggcgaggggcugcacaagcugggcuacauccuccgcgacgugagcaugaaggagggcggggccauguacgccgacgacaccgccggcugggacacgcggaucacccuggaggaccugaagaacgaggagauggucaccaaccacauggagggggagcacaagaagcucgccgaggcgaucuucaagcugaccuaccagaacaagguggugcgcguccagcggcccacgccccgcggcaccgugauggacaucaucucccggcgcgaccagcgggggagcggccagguggucaccuacggccugaacaccuucacgaacauggaggcccagcucauccgccagauggagggggagggcguguucaaguccauccagcagcugaccgugaccgaggagaucgccgucaagaacuggcuggugcgcguggggcgggagcgccucagccggauggccaucuccggcgacgacugcgucgugaagccccuggacgaccgcuucgccagcgcgcugaccgcccucaacgacaugggcaaggugcggaaggacauccagcagugggagccgucccgcggguggaacgacuggacgcagguccccuucugcagccaccacuuccacgagcugaucaugaaggacggccgggugcuggugguccccugccgcaaccaggacgagcucaucgggcgggcccgcaucucccagggcgccggguggagccugcgggagaccgccugccugggcaaguccuacgcgcagauguggagccucauguacuuccaccgccgggaccugcgccuggccgccaacgccaucugcuccgccgugcccagccacugggugccgaccucccggaccaccuggagcauccacgcgacgcacgaguggaugaccaccgaggacaugcucaccgucuggaaccgcguguggauccaggagaaccccuggauggaggacaagacgcccguggaguccugggaggagauccccuaccugggcaagcgggaggaccaguggugcgggagccugaucggccucaccagccgcgccaccugggccaagaacauccagaccgccaucaaccagguccggucccugaucgggaacgaggaguacacggacuacaugccgagcaugaagcgcuuccgccgggaggaggaggaggcgggcgugcugugguga

SEQ ID NO: 9694 - RNA, 9876 nt, Artificial Sequence
  derived and/or modified CDS sequence (opt1) from DENV-2__KC762680__SS-prME
accgccggcaucaucaucaugaugauccccaccgugauggccuuccaccugaccacccggaacggggagccccacaugaucgucagccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcgguacguccugggccgccucaucacggugaacccgaucgugaccgagaaggacucccccgucaacaucgaggccgagccgcccuucggggacagcuacaucaucaucggcguggagccggggcagcugaagcugaacugguucaagaagggcuccagcaucgggcagauguucgagaccaccaugcgcggcgccaagcggauggccauccucggcgacacggccugggacuucgggucccugggcgggguguucaccagcaucggcaaggcgcugcaccaggucuucggggccaucuacggcgccgccuucuccggcgugagcuggaccaugaagauccucaucgggguggucaucaccuggaucggcaugaacucccgcagcacgucccugagcgugucccuggugcuggucgggguggugacccucuaccugggcgucauggugcaggcggacagcgggugcguggucuccuggaagaacaaggagcugaagugcggcagcggcaucuucaucaccgacaacgugcacaccuggacggagcaguacaaguuccagcccgagagccccuccaagcucgccagcgccauccagaaggcccacgaggaggggaucugcggcauccgguccgugacccgccuggagaaccugauguggaagcagaucacccccgagcucaaccacauccugagcgagaacgaggucaagcugaccaucaugacgggggacaucaagggcaucaugcaggccgggaagcggucccuccgcccgcagcccaccgagcugaaguacagcuggaaggcguggggcaaggccaagaugcuguccaccgagcuccacaaccacaccuuccugaucgacggccccgagacggccgagugcccgaacaccaaccgggccuggaacagccuggagguggaggacuacggguucggcguguucaccaccaacaucuggcucaagcugaaggagcgccaggacgucuucugcgacuccaagcugaugagcgccgcgaucaaggacucccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcaccacgguggucgugaccgaggacugcgggaaccgcggccccagccugcggaccaccacggccuccggcaagcucaucaccgaguggugcugccgcagcugcacccugcccccgcugcgguaccgcggggaggacggcugcugguacgggauggagauccggccccucaaggagaaggaggagaaccuggugaacucccuggucaccgccggccacgggcagaucgacaacuucagccucggcgugcugggcauggcgcuguuccucgaggagaugcugcgcacgcggguggggaccaagcacgccauccugcucgucgccguguccuucgugacccugaucaccggcaacaugagcuuccgcgaccuggggcgcgucauggugauggugggcgccacgaugaccgacgacaucgggaugggcgucaccuaccucgcccugcuggcggccuucaaggugcggcccaccuucgccgccggccuccugcugcgcaagcucacguccaaggagcugaugaugaccaccaucgggaucgugcugcucagccaggccaccauccccgagacgauccuggagcugaccgacgcgcucgcccugggcaugaugguccugaagaucgugcggaacauggagaaguaccagcucgccgucaccaucauggccauccugugcgugccgaacgccgugauccugcagaacgcguggaaggucuccugcaccacgcucgccguggugagcgucagcccccugcugcucaccagcucccagcagaaggccgacuggaucccccuggcccugaccaucaaggggcucaaccccaccgcgaucuuccugacgacccugagccgcaccuccaagaagcggagcuggccgcucaacgaggccaucauggccgugggcaugguguccauccuggccagcucccugcucaagaacgacauccccaugaccggcccccuggucgccgggggccugcucacggugugcuacgugcugaccgggcgcagcgcggaccuggagcucgagcgggccgccgacguccgcugggaggagcaggccgagaucagcggcuccagccccauccuguccaucaccaucagcgaggacggguccaugagcaucaagaacgaggaggaggagcagacccugacgauccucauccggaccggccugcuggugaucuccggccucuucccggugagcauccccaucaccgccgcggccugguaccugugggaggucaagaagcagcgcgccggggugcugugggacgugcccagcccgccgcccgucggcaaggccgagcucgaggacggggccuaccggaucaagcagaagggcauccugggguacagccagaucggcgcgggcguguacaaggaggggaccuuccacaccauguggcacgugacgcgcggcgccguccugaugcacaaggggaagcggaucgagcccuccugggccgacgugaagaaggaccucaucagcuacggcgggggcuggaagcuggagggcgaguggaaggagggggaggaggugcagguccuggcccucgagcccggcaagaacccccgcgccgugcagaccaagcccgggcuguucaagaccaacaccggcacgaucggggcggugucccuggacuucagccccggcaccuccggcagccccaucgucgacaagaaggggaagguggugggccucuacgggaacggcgucgugacccgguccggcaccuacgugagcgccaucgcccagacggagaaguccaucgaggacaaccccgagaucgaggacgacaucuuccgcaagaagcggcugaccaucauggaccugcaccccggggccggcaagaccaagcgcuaccugcccgcgaucguccgggaggccaucaagcgcgggcuccggacccugauccuggccccgacgcgcgugguggccgccgagauggaggaggcgcuccgcggccugcccauccgguaccagacccccgccauccgcgccgagcacaccgggcgggagaucgucgaccugaugugccacgccaccuucacgaugcgccuccugagccccauccgggugccgaacuacaaccugaucaucauggacgaggcccacuucaccgaccccgcgagcaucgccgcccgcggcuacaucuccacccggguggagaugggcgaggccgccgggaucuucaugaccgcgacgccgcccggcagccgcgacccguucccccaguccaacgcccccaucauggacgaggagcgggagauccccgagcgcagcuggaacuccgggcacgagugggucaccgacuucaagggcaagaccgugugguucgugccgagcaucaaggccgggaacgacaucgccgcgugccuccggaagaacggcaagaaggucauccagcugucccgcaagaccuucgacuucgaguacaucaagacgcggaccaacgacugggacuucguggugaccaccgacaucagcgagaugggcgccaacuucaaggccgagcgcgucaucgacccccggcgcugcaugaagcccgugauccugacggacggggaggagcgggugauccucgccggccccaugccggucacccacuccagcgccgcgcagcgccgggggcgcgugggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgccaucgacggcgaguaccgccugcgcggggaggcccgcaagaccuucgucgaccugaugcggcgcggcgaccuccccguguggcuggcguaccgggucgccgccgaggggaucaacuacgccgaccgccgguggugcuucgacggcgugaagaacaaccagauccuggaggagaacguggaggucgagaucuggacgaaggagggggagcgcaagaagcucaagccgcgguggcuggacgcccgcaucuacagcgacccccuggcgcucaaggaguucaaggaguucgccgccggccggaagucccugacccugaaccucaucaccgagaugggccgccugcccaccuucaugacgcagaaggcccggaacgcgcuggacaaccucgccgugcugcacaccgccgaggccgggggccgcgccuacaaccacgcgcugagcgagcuccccgagacccuggagacccugcuccugcugacgcuccuggccaccgugaccgggggcaucuuccuguuccucauguccggcaaggggaucggcaagaugacccuggggaugugcugcaucaucaccgccagcauccugcucugguacgcccagauccagccgcacuggaucgccgcguccaucauccuggaguucuuccugaucguccuccugauccccgagcccgagaagcagcggacgccccaggacaaccagcugaccuacguggugaucgccauccucaccgucguggccgccaccauggccaacgagaugggcuuccuggagaagacgaagaaggacuucgggcugggcagcaucaccacccagcagccggaguccaacauccucgacaucgaccugcgccccgcgagcgccuggacccuguacgccguggccacgaccuucaucacccccaugcuccggcacagcaucgagaacuccagcgucaacgugucccugaccgccaucgcgaaccaggccacggugcugaugggccucgggaagggcuggccccugagcaagauggacaucggggucccgcugcucgccaucggcugcuacucccaggugaaccccaucacccugaccgccgcgcugcuccugcugguggcccacuacgccaucaucgggcccggccuccaggccaaggccacccgcgaggcgcagaagcgggccgccgccggcaucaugaagaaccccacggucgacgggaucaccgugaucgaccuggacccgauccccuacgaccccaaguucgagaagcagcugggccaggugaugcuccugguccugugcgugacccaggugcucaugaugcgcaccacgugggcccugugcgaggcgcugacccucgccaccgggcccaucagcacccugugggagggcaacccggggcgcuucuggaacacgaccaucgccgucuccauggccaacaucuuccggggcagcuaccuggccggcgcggggcuccuguucuccaucaugaagaacaccgccaacacccgccggggcacggggaacaccggcgagacccugggcgagaaguggaagaaccgccucaacgcccuggggaaguccgaguuccagaucuacaagaaguccggcauccaggagguggaccggacccuggccaaggaggggaucaagcgcggcgagacggaccaccacgcggugagccggggguccgccaagcuccgcugguucgucgagcggaaccuggugacccccgagggcaagguggucgaccugggcugcgggcgcggcggguggagcuacuacugcggcgggcucaagaacgugaaggaggugaagggccugaccaagggcgggcccggccacgaggagcccaucccgauguccaccuacggguggaaccugguccggcuccagagcggcguggacguguucuucacgccgcccgagaagugcgacacccugcugugcgacaucggggaguccagccccaacccgaccgucgaggccggccgcacccuccgggugcugaaccugguggagaacuggcucaacaacaacacccaguucugcaucaagguccugaaccccuacaugcccuccgugaucgagaagauggaggcccugcagcgcaaguacggcggggcccuggugcggaacccgcucagccgcaacagcacgcacgagauguacugggucuccaacgcgagcggcaacaucguguccagcgugaacaugaucucccggaugcugaucaaccgcuucaccaugcggcacaagaaggccaccuacgagcccgacgucgaccuggggagcggcacccgcaacaucgggaucgaguccgagacgcccaaccucgacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgugguccggcugcugaccaagccgugggacgugauccccauggugacccagauggccaugaccgacacgacccccuucgggcagcagcgcgucuucaaggagaagguggacacccggacccaggagcccaaggagggcacgaagaagcucaugaagaucaccgcggaguggcuguggaaggagcugggcaagaagaagaccccgcgcaugugcacccgggaggaguucacgcgcaagguccgguccaacgccgcccucggggccaucuucaccgacgagaacaaguggaaguccgcccgcgaggcgguggaggacuccggcuucugggagcugguggacaaggagcggaaccugcaccucgaggggaagugcgagaccugcgucuacaacaugaugggcaagcgcgagaagaagcugggggaguucggcaaggccaagggcagccgggccaucugguacauguggcugggggcccgcuuccucgaguucgaggcgcugggcuuccugaacgaggaccacugguucucccgggagaacagccucuccgggguggagggcgaggggcugcacaagcugggcuacauccuccgcgacgugagcaugaaggagggcggggccauguacgccgacgacaccgccggcugggacacgcggaucacccuggaggaccugaagaacgaggagauggucaccaaccacauggagggggagcacaagaagcucgccgaggcgaucuucaagcugaccuaccagaacaagguggugcgcguccagcggcccacgccccgcggcaccgugauggacaucaucagccggcgcgaccagcggggguccggccagguggucaccuacggccugaacaccuucacgaacauggaggcccagcucauccgccagauggagggggagggcguguucaagagcauccagcagcugaccgugaccgaggagaucgccgucaagaacuggcuggugcgcguggggcgggagcgccucucccggauggccaucagcggcgacgacugcgucgugaagccccuggacgaccgcuucgccuccgcgcugaccgcccucaacgacaugggcaaggugcggaaggacauccagcagugggagccgagccgcggguggaacgacuggacgcagguccccuucugcucccaccacuuccacgagcugaucaugaaggacggccgggugcuggugguccccugccgcaaccaggacgagcucaucgggcgggcccgcaucagccagggcgccggguggucccugcgggagaccgccugccugggcaagagcuacgcgcagauguggucccucauguacuuccaccgccgggaccugcgccuggccgccaacgccaucugcagcgccgugcccucccacugggugccgaccagccggaccaccugguccauccacgcgacgcacgaguggaugaccaccgaggacaugcucaccgucuggaaccgcguguggauccaggagaaccccuggauggaggacaagacgcccguggagagcugggaggagauccccuaccugggcaagcgggaggaccaguggugcgggucccugaucggccucaccagccgcgccaccugggccaagaacauccagaccgccaucaaccagguccggagccugaaggggaacgaggaguacacggacuacaugccguccaugaagcgcuuccgccgggaggagggcgaggcgggggugcugugguga

SEQ ID NO: 9695 - RNA, 9876 nt, Artificial Sequence
  derived and/or modified CDS sequence (opt1) from DENV-2__JQ955624__SS-prME
accgccggcgucaucaucaugcugauccccaccgccauggcguuccaccucaccacccggaacggggagccccacaugaucgucagccggcaggagaagggcaagagccugcuguucaagaccgaggacggggugaacaugugcacccucauggccauggaccugggcgagcugugcgaggacaccaucaccuacaacugcccccuccugcggcagaacgagcccgaggacaucgacugcuggugcaacagcaccagcaccugggugaccuacgggaccugcaccgccaccggcgagcaccggcgggagaagcggagcgucgcccuggugccccacgugggcauggggcucgagacccgcaccgagaccuggauguccagcgagggcgccuggaagcacgcgcagcggaucgagaccuggauccugcgccaccccggguucgccaucauggccgccauccuggcguacacgaucggcaccacccacuuccagcggguccucaucuucauccugcugaccgccguggcccccuccaugacgaugcgcugcaucgggaucagcaaccgggacuucguggagggcgucuccggcgggagcuggguggacaucgugcucgagcacggcuccugcgucaccaccauggccaagaacaagcccacccuggacuucgagcugaucaagacggaggccaagcagcccgcgacccuccgcaaguacugcaucgaggccaagcugaccaacaccacgaccgccagccggugcccgacccagggggagcccucccugaacgaggagcaggacaagcgcuucgugugcaagcacagcaugguggaccggggcuggggcaacgggugcggccucuucgggaagggcgggaucgugaccugcgccauguucacgugcaagaagaacauggagggcaagaucgugcagcccgagaaccuggaguacaccaucguggucacgccccacuccggcgaggagaacgccguggggaacgacaccggcaagcacgggaaggagaucaaggugacgccgcagagcuccaucaccgaggcggagcugaccggcuacgggaccgucaccauggagugcagcccccgcacgggccucgacuucaacgagauggugcugcugcagauggagaacaaggccuggcucgugcaccggcagugguuccuggaccugccccuccccuggcugccgggcgccgacacccagggguccaacuggauccagaaggagacccuggucaccuucaagaacccccacgccaagaagcaggacguggucgugcucggcagccaggagggggccaugcacacggcgcugaccggcgccaccgagauccagaugagcuccgggaaccuccuguucaccggccaccugaagugccgccugcggauggacaagcuccagcugaagggcaugagcuacuccaugugcacggggaaguucaagguggucaaggagaucgccgagacccagcacggcaccaucguggugcgcguccaguacgagggggacggcagccccugcaagauccccuucgagaucauggaccuggagaagcggcacgugcucggccgccugaucaccgugaacccgaucgucacggagaaggacucccccgugaacaucgaggccgagccgcccuucggggacagcuacaucaucaucggcguggagccggggcagcugaagcucuccugguucaagaagggcagcuccaucgggcagauguucgagaccaccaugcgcggcgccaagcggauggcgauccugggcgacaccgccugggacuucgggagccugggcggggucuucacguccaucggcaaggcccuccaccagguguucggggccaucuacggcgcggccuucagcggcguguccuggaccaugaagauccugaucggggucgugaucaccuggaucggcaugaacagccgcuccaccagccuguccgugagccugguccucguggggguggucacgcuguaccugggcgugauggugcaggccgacuccgggugcgucgugagcuggaagaacaaggagcucaagugcggcagcggcaucuucaucaccgacaacgugcacaccuggaccgagcaguacaaguuccagcccgagucccccagcaagcuggccuccgccauccagaaggcgcacgaggaggggaucugcggcauccggagcgucacgcgccuggagaaccucauguggaagcagaucacccccgagcugaaccacauccuguccgagaacgaggugaagcucaccaucaugaccggggacaucaagggcaucaugcaggccgggaagcggagccugcgcccgcagcccacggagcugaaguacuccuggaagaccuggggcaaggccaagaugcucagcaccgagucccacaaccagaccuuccugaucgacggccccgagacgaccgagugcccgaacaccaaccgggccuggaacagccuggagguggaggacuacggguucggcgucuucaccacgaacaucuggcucaagcugaaggagcgccaggacguguucugcgacuccaagcugaugagcgccgcggugaaggacaaccgggccguccacgccgacaugggguacuggaucgaguccgcccucaacgacaccuggaagaucgagaaggccagcuucaucgaggugaaguccugccacuggcccaagagccacacccugugguccaacggcgugcuggagagcgagaugaucauccccaagaacuucgcgggccccgucagccagcacaacuaccgcccgggguaccacacccagaccgccggccccuggcaccucgggaagcuggagauggacuucgacuucugcgagggcacgaccgugguggucaccgaggacugcgggaaccggggccccucccugcgcaccacgaccgccagcggcaagcucaucaccgaguggugcugccgguccugcacccugcccccgcugcgcuaccgcggggaggacggcugcugguacgggauggagauccgcccccucaaggagaaggaggagaaccuggugaacagccuggugacggccggccacgggcagaucgacaacuucucccucggcauccugggcauggcgcuguuccucgaggagaugcugcggacccgcgucgggaccaagcacgccgugcugcucguggccgucagcuucaugacccugaucacgggcaacauguccuuccgggaccuggggcgcgugauggugauggucggcgccgccaugaccgacgacaucgggaugggcgugaccuaccucgcgcugcuggccgccuucaaggugcgccccaccuucgccgccggccuccugcugcggaagcucacgagcaaggagcugaugaugaccaccaucgggaucguccugcucucccagagcaccauccccgagacgauccuggagcugaccgacgcgcucgcccugggcaugauggugcugaagaucguccgcaacauggagaaguaccagcucgccgugaccaucauggccauccugugcgugccgaacgccgucauccugcagaacgcguggaagguguccugcaccauccucgccguggucagcgugagcccccugcugcucacgagcucccagcagaaggccgacuggaucccccuggcccugaccaucaaggggcucaaccccaccgcgaucuuccugaccacgcugagccggaccaacaagaagcgcuccuggccgcucaacgaggccaucauggccgugggcauggucagcauccuggccuccagccugcucaagaacgacauccccaugaccggcccccugguggccgggggccugcucaccgugugcuacguccugacggggcggagcgcggaccuggagcucgagcgcgccgccgacgugcggugggaggaccaggccgagaucuccggcagcucccccauccugagcaucaccaucuccgaggacgggagcauguccaucaagaacgaggaggaggagcagacccugaccauccucauccgcacgggccugcuggugaucagcggccucuucccggucuccauccccaucaccgccgcggccugguaccugugggaggugaagaagcagcgggccggggugcugugggacguccccuccccgccgcccgugggcaaggccgagcucgaggacggggccuaccgcaucaagcagaagggcauccugggguacucccagaucggcgcgggcguguacaaggaggggaccuuccacaccauguggcacgucacccggggcgccgugcugaugcacaaggggaagcgcaucgagcccagcugggccgacgugcggaaggaccucaucuccuacggcgggggcuggaagcuggagggcgaguggaaggagggggaggagguccaggugcuggcccucgagcccggcaagaacccccgcgccgugcagacgaagcccgggcuguucaagaccaacaccggcaccaucggggcggucagccuggacuucucccccggcacgagcggcucccccaucguggacaagaaggggaagguggucggccucuacgggaacggcguggugacccggagcggcaccuacgucuccgccaucgcccagagcgagaaguccaucgaggacaaccccgagaucgaggacgacaucuuccgcaagaagcggcugaccaucauggaccugcaccccggggccggcaagacgaagcgcuaccugcccgcgaucgugcgggaggccaucaagcgcgggcuccggacccugauccuggccccgacccgcguggucgccgccgagauggaggaggcgcuccgcggccugcccauccgguaccagacccccgccauccgcgccgagcacacggggcgggagaucguggaccugaugugccacgccaccuucaccaugcgccuccugucccccgugcgggucccgaacuacaaccugaucaucauggacgaggcccacuucaccgaccccgcgagcaucgccgcccgcggcuacaucuccacgcggguggagaugggcgaggccgccgggaucuucaugaccgcgacgccgcccggcagccgcgacccguucccccaguccaacgcccccaucauggacgaggagcgggagauccccgagcgcagcuggaacuccgggcacgagugggugaccgacuucaagggcaagacggucugguucgugccgagcaucaaggccgggaacgacaucgccgcgugccuccggaagaacggcaagaaggugauccagcugucccgcaagaccuucgacagcgaguacaucaagacccggaccaacgacugggacuucgucgugacgaccgacaucuccgagaugggcgccaacuucaaggccgagcgcgugaucgacccccggcgcugcaugaagcccgucauccugaccgacggggaggagcgggugauccucgccggccccaugccggugacccacagcuccgccgcgcagcgccgggggcgcaucggccgcaaccccaagaacgagaacgaccaguacaucuacaugggggagccccuggagaacgacgaggacugcgcccacuggaaggaggccaagaugcugcucgacaacaucaacacgcccgagggcaucaucccgagcauguucgagcccgagcgggagaaggucgacgccaucgacggcgaguaccgccugcgcggggaggcccgcaagaccuucguggagcugaugcggcgcggcgaccuccccgucuggcuggcguaccggguggccgccgaggggaucaacuacgccgaccgccgguggugcuucgacggcaucaagaacaaccagauccuggaggagaacguggaggucgagaucuggaccaaggagggggagcgcaagaagcucaagccgcgguggcuggacgcccgcaucuacuccgacccccuggcgcucaaggaguucaaggaguucgccgccggccgcaagagccugacccugaaccucaucacggagaugggccgccugcccaccuucaugacccagaaggcccggaacgcgcuggacaaccucgccgugcugcacaccgccgaggccgggggccgcgccuacaaccacgcgcuguccgagcuccccgagacgcuggagacccugcuccugcugacccuccuggccaccgugaccggcgggaucuuccuguuccucaugagcgggaaggggaucggcaagaugacccuggggaugugcugcaucaucaccgccuccauccugcucugguacgcccagauccagccgcacuggaucgccgcgagcaucauccuggaguucuuccugaucguccuccugauccccgagcccgagaagcagcggacgccccaggacaaccagcugaccuacguggugaucgccauccucacggucguggccgccaccauggccaacgagaugggcuuccuggagaagaccaagaaggacuucggguucggcagcaucgcgacccagcagccggaguccaacauccuggacaucgaccuccgccccgccagcgccuggacgcuguacgccguggccaccaccuucaucacccccaugcugcggcacuccaucgagaacagcuccgucaacgugagccucacggcgaucgccaaccaggccaccgugcugaugggccuggggaagggcuggccccucuccaagauggacaucggggucccgcugcuggccaucggcugcuacagccaggugaaccccaucacccucaccgcggcccugcugcuccugguggcccacuacgccaucaucgggcccggccugcaggccaaggcgacgcgcgaggcccagaagcgggccgccgccggcaucaugaagaaccccaccgucgacgggaucaccgugaucgaccucgacccgauccccuacgaccccaaguucgagaagcagcugggccaggugaugcugcucguccugugcgugacccaggugcugaugaugcgcacgaccugggcgcucugcgaggcccugacccuggccaccgggcccaucuccacgcucugggagggcaacccggggcgcuucuggaacaccaccaucgccgucagcauggccaacaucuuccggggcuccuaccuggcgggcgccgggcuccuguucagcaucaugaagaacaccacgaacacccgccggggcaccgggaacaccggcgagacgcugggcgagaaguggaagaaccgccugaacucccucggcaagagcgaguuccagaucuacaagcgguccggcauccaggagguggaccgcacccuggccaaggaggggaucaagcggggcgagaccgaccaccacgccgugagccgcggguccgcgaagcugcggugguucgucgagcgcaaccucgugacccccgagggcaaggugauggaccugggcugcgggcggggcggguggagcuacuacugcggcgggcugaagaacguccgcgaggugaagggccucacgaagggcgggcccggccacgaggagcccaucccgauguccaccuacggguggaaccuggugcggcugcagagcggcgucgacguguucuucacgccgcccgagaagugcgacacccuccugugcgacaucggggagagcucccccaacccgacgguggaggccggccgcacccugcggguccucaaccugguggagaacuggcugaacaacaacacccaguucugcaucaaggugcucaaccccuacaugcccagcgucaucgagaagauggagacccugcagcgcaaguacggcggggcccuggugcggaacccgcugucccgcaacagcacccacgagauguacuggguguccaacgccagcggcaacaucgucuccagcgugaacaugaucucccggaugcucaucaaccgcuucacgaugcgccacaagaaggccaccuacgagcccgacguggaccuggggagcggcacccggaacaucgggaucgaguccgagacccccaaccuggacaucaucggcaagcgcaucgagaagaucaagcaggagcacgagacgagcuggcacuacgaccaggaccaccccuacaagaccugggcguaccacggcuccuacgagaccaagcagaccgggagcgccuccagcauggucaacggcguggugcggcuccugacgaagccgugggacgucauccccauggugacccagauggccaugaccgacaccacgcccuucgggcagcagcgcguguucaaggagaaggucgacacccggacccaggagcccaaggagggcaccaagaagcugaugaagaucacggccgaguggcucuggaaggagcugggcaagaagaagaccccgcgcaugugcacccgggaggaguucacccgcaaggugcgguccaacgccgcgcugggggccaucuucacggacgagaacaaguggaaguccgcccgcgaggccgucgaggacucccgguucugggagcucguggacaaggagcgcaaccugcaccuggagggcaagugcgagaccugcguguacaacaugauggggaagcgggagaagaagaugggcgaguucgggaaggccaagggcagccgcgcgaucugguacauguggcucggcgcccgguuccuggaguucgaggcccugggguuccucaacgaggaccacugguucagccgcgagaacucccugagcggcgucgagggggagggccugcacaagcucggguacauccugcgggagguguccaagaaggagggcggcgccauguacgcggacgacaccgccgggugggacacccgcaucacgcuggaggaccucaagaacgaggagauggugaccaaccacauggagggcgagcacaagaagcuggccgaggccaucuucaagcugaccuaccagaacaaggucgugcgggugcagcgccccacgccccgggggacggucauggacaucaucagccgccgcgaccagcggggcuccggccagguggggaccuacggccucaacaccuucaccaacaugggggcccagcugauccgccagauggagggcgaggggguguucaagagcauccagcaccugacgaccaccgaggaggucgcggugcaggacuggcucgcccgggugggccgcgagcggcugucccgcauggccaucagcggcgacgacugcgucgugaagccccuggacgaccgguucgccuccgcccucaccgcgcugaacgacauggggaaggugcgcaaggacauccagcagugggagccgagccggggcuggaacgacuggacgcagguccccuucugcucccaccacuuccacgagcugaucaugaaggacgggcgcgugcucgugguccccugccggaaccaggacgagcugaucggccgcgcccggaucagccagggggccggcuggucccugcgcgagaccgccugccucggcaagagcuacgcccagauguggucccugauguacuuccaccggcgcgaccugcggcucgcggccaacgccaucugcagcgccgugcccucccacugggugccgaccagccgcaccaccuggagcauccacgcccggcacgaguggaugacgaccgaggacaugcugaccgucuggaaccgcguguggauccaggagaaccccuggauggaggacaagacccccguggaguccugggaggagauccccuaccuggggaagcgcgaggaccaguggugcggcagccucaucgggcugacgucccgggcgaccugggccaagaacauccagaccgccaucaaccagguccgcagccugaucggcuccgaggaguacaccgacuacaugccgagcaugaagcgguuccgccgggaggaggaggaggccggggugcucugguga

SEQ ID NO: 9696 - RNA, 9876 nt, Artificial Sequence
  derived and/or modified CDS sequence (opt1) from DENV-2__KJ918750__SS-prME
accgcgggcaugaucaucaugcugauccccaccgugauggccuuccaccucaccacccgcaacggggagccccacaugaucgugagccggcaggagaagggcaagagccugcuguucaagaccaaggacgggaccaacaugugcacccucauggcgauggaccugggcgagcugugcgaggacaccaucaccuacaagugccccuuccuccgccagaacgagcccgaggacaucgacugcuggugcaacagcaccagcaccugggugaccuacgggaccugcaccaccaccggcgagcaccggcgcgagaagcggagcguggcccuggucccccacgugggcauggggcuggagacccgcaccgagacguggauguccagcgagggcgccuggaagcacgcccagcggaucgagaucuggauccuccgccacccgggguucaccaucauggccgcgauccuggccuacaccaucggcaccacgcacuuccagcgggugcugaucuucauccuccugaccgccaucgcccccuccaugaccaugcgcugcaucgggaucagcaaccgggacuucgucgagggcguguccggcgggagcuggguggacaucguccuggagcacggcuccugcgugaccacgauggcgaagaacaagcccacccucgacuucgagcugaucaagaccgaggccaagcagcccgccacccugcgcaaguacugcaucgaggccaagcucacgaacaccaccaccgacagccggugccccacgcagggggagcccacccugaacgaggagcaggacaagcgcuucgugugcaagcacuccauggucgaccggggcuggggcaacgggugcggccuguucgggaagggcgggaucgugaccugcgccauguucacgugcaagaagaucaugaagggcaagaucgugcagcccgagaaccucgaguacacggucgugaucacgccccacagcggcgaggagcacgcgguggggaacgacaccggcaagcacgggaaggaggucaagaucaccccgcaguccagcaucaccgaggccgagcugacgggcuacgggaccgugaccauggagugcagcccccggaccggccuggacuucaacgagauggugcuccugcagauggaggacaaggccuggcugguccaccggcagugguuccucgaccugccccugcccuggcucccgggcgccgacacgcaggggagcaacuggauccagaaggagacccuggugaccuucaagaacccccacgccaagaagcaggacguggucgugcugggcucccaggagggggcgaugcacaccgcccucacgggcgccaccgagauccagaugagcagcgggaaccugcuguucaccggccaccucaagugccgccugcggauggacaagcugcagcucaagggcauguccuacagcaugugcaccgggaaguucaaggucgugaaggagaucgccgagacgcagcacggcaccaucgugauccgcguccaguacgagggggacggcucccccugcaagauccccuucgagaucauggaccuggagaagcggcacgugcugggccgccucaucaccgugaacccgaucgucaccgagaaggacagccccgugaacaucgaggccgagccgcccuucggggacuccuacaucaucaucggcguggagccggggcagcugaagcugaacugguucaagaagggcagcuccaucgggcagaugcucgagacgaccaugcgcggcgcgaagcggauggccauccugggcgacaccgccugggacuucgggagccugggcggggucuucaccuccaucggcaaggcccuccaccagguguucggggccaucuacggcgcggccuucagcggcguguccuggacgaugaagauccugaccggggucaucaucaccuggaucggcaugaacagccgcuccaccagccuguccgugagccuggugcucgucgggaucgugacgcuguaccugggcgugaugguccaggccgacuccgggugcguggugagcuggaagaacaaggagcucaagugcggcuccggcaucuucgucaccgacaacgugcacaccuggaccgagcaguacaaguuccagcccgagagccccagcaagcuggccuccgcgauccagaaggcccacgaggaggggaucugcggcauccggagcgugacgcgccuggagaaccucauguggaagcagaucacccccgagcugaaccacauccuguccgagaacgaggucaagcucaccaucaugaccggggacaucaagggcaucaugcaggucgggaagcggagccugcgcccgcagcccacggagcugcgguacuccuggaagaccuggggcaaggccaagaugcucagcaccgagcugcacaaccagaccuuccugaucgacggccccgagacggccgagugcccgaacaccaaccgcgccuggaacucccucgagguggaggacuacggguucggcgucuucaccaccaacaucuggcugcggcugcgcgagaagcaggacguguucugcgacagcaagcucauguccgcggccaucaaggacaaccgggccgugcacgccgacaugggguacuggaucgagagcgcccugaacgacaccuggaagaucgagaaggcguccuucaucgaggucaagagcugccacuggcccaagucccacacgcuguggagcgacggcgugcucgaguccgagauggugauccccaagaacuucgccggccccgucagccagcacaacaaccgcccgggguaccacacccagaccgccggccccuggcaccuggggaagcuggagauggacuucgacuucugcgagggcaccacggugguggucaccgaggacugcgggaaccggggccccucccuccgcaccaccacggccagcggcaagcugaucaccgaguggugcugccggagcugcacccugcccccgcuccgcuaccgcggggaggacggcugcugguacgggauggagauccgcccccugaaggagaaggaggagaaccugguguccagccucgugaccgccggccacgggcagaucgacaacuucucccugggcauccugggcauggcccuguuccuggaggagaugcugcggacgcgcgucgggaccaagcacgccauccuccugguggccgugagcuucgucacccugaucaccggcaacauguccuuccgcgaccucgggcgggugauggugauggucggcgccacgaugaccgacgacaucgggaugggcgugaccuaccuggcgcugcucgccgccuucaaggugcgccccaccuucgccgccggccugcugcuccggaagcugacgagcaaggagcugaugaugaccaccaucgggaucguccuccugucccagagcuccauccccgagaccauccuggagcucacggacgcgcuggcccugggcaugauggugcucaagauggugcgcaacauggagaaguaccagcuggccgucaccaucauggccauccugugcgugccgaacgccgucauccuccagaacgcguggaaggugagcugcaccauccuggcccugguguccgucagcccccucuuccugaccuccagccagcagaaggccgacuggaucccccuggcccucacgaucaaggggcugaaccccaccgccaucuuccugaccacccucucccggacgagcaagaagcgcuccuggccgcugaacgaggcgaucauggccgugggcauggugagcauccuggccuccagccuccugaagaacgacauccccaugaccggcccccuggucgccgggggccuccugaccgugugcuacgugcugaccgggcggagcgcggaccucgagcuggagcgcgccgccgacgucaagugggacgaccaggccgagaucuccggcagcucccccauccugagcaucacgaucuccgaggacgggagcauguccaucaagaacgaggaggaggagcagacccucaccauccugauccggaccggccugcucgugaucagcggccuguucccgguguccauccccaucaccgccgcggccugguaccugugggaggucaagaagcagcgcgccggggugcucugggacgugcccuccccgccgcccgucggcaaggccgagcuggaggacggggccuaccggaucaagcagaagggcauccugggguacucccagaucggcgcgggcguguacaaggaggggacguuccacaccauguggcacgugacccgcggcgccguccucaugcacaaggggaagcggaucgagcccagcugggccgacgugaagaaggaccugaucuccuacggcgggggcuggaagcuggagggcgaguggaaggagggggaggaggugcagguccucgcccuggagcccggcaagaacccccgcgccgugcagaccaagcccgggcuguucaagacgaacaccggcaccaucggggcggugagccucgacuucucccccggcaccagcggcucccccaucgucgacaagaaggggaagguggugggccuguacgggaacggcgucgugacgcggagcggcgccuacguguccgccaucgcccagaccgagaaguccaucgaggacaaccccgagaucgaggacgacaucuuccgcaagcggcgccugaccaucauggaccugcaccccggggccggcaagaccaagcgguaccuccccgcgaucguccgcgaggccaucaagcgggggcugcgcacgcugauccucgccccgacccgcgugguggccgcggagauggaggaggcccugcggggccugcccauccgcuaccagacccccgccauccgggccgagcacaccgggcgcgagaucgucgaccucaugugccacgccacguucaccaugcggcugcugagccccauccgcgugccgaacuacaaccucaucaucauggacgaggcgcacuucaccgaccccgccuccaucgccgcccggggcuacaucagcacccgcguggagaugggcgaggccgcggggaucuucaugacggccacgccgcccggcucccgggacccguucccccagagcaacgcccccaucauggacgaggagcgcgagauccccgagcgguccuggaacagcgggcacgagugggucaccgacuucaagggcaagaccgugugguucgugccguccaucaagacggggaacgacaucgccgccugccugcgcaagaacggcaagcgggucauccagcugagccgcaagaccuucgacuccgaguacgugaagacccggaccaacgacugggacuucguggucacgaccgacaucagcgagaugggcgcgaacuucaaggccgagcgcgugaucgacccccggcgcugcaugaagcccgugauccucaccgacggggaggagcgggucauccuggccggccccaugccggugacccacuccagcgccgcgcagcgccgcgggcggaucggccgcaaccccaagaacgagaacgaccaguacaucuacaugggggagccccuggagaacgacgaggacugcgcccacuggaaggaggccaagaugcuccuggacaacaucaacacgcccgagggcaucaucccguccauguucgagcccgagcgggagaagguggacgccaucgacggcgaguaccgccugcgcggggaggcccgcaagaccuucgucgaccucaugcggcgcggcgaccugcccguguggcuggcguacaagguggccgccgaggggaucaacuacgccgaccggcgcuggugcuucgacggcacccggaacaaccagauccucgaggagaacgucgagguggagaucuggaccaaggagggggagcgcaagaagcugaagccgcgguggcuggacgcccgcaucuacagcgacccccucgcgcugaaggaguucaaggaguucgccgccggccggaagucccugacgcucaaccugaucaccgagaugggccgccugcccaccuucaugacccagaaggcccgggacgcccucgacaaccuggcgguccugcacacggccgaggccgggggcaaggccuacaaccacgcgcucagcgagcugcccgagacccuggagacccuccugcugcucacccugcuggccaccgugaccgggggcaucuuccucuuccugauguccggccgcgggaucggcaagaugacccuggggaugugcugcaucaucaccgccagcauccuccuguggugcgcccagauccagccgcacuggaucgccgcguccaucauccuggaguucuuccucaucgugcugcugauccccgagcccgagaagcagcggacgccccaggacaaccagcucacguacgucaucaucgccauccugaccgugguggccgccaccauggccaacgagaugggcuuccuggagaagaccaagaaggaccucgggcugggcaacaucgucacgcagcagccggagagcaacauccuggacaucgaccuccgccccgcgagcgccuggacccuguacgccguggccaccaccuucaucacgcccaugcugcggcacuccaucgagaacagcuccgugaacaugagccucaccgccaucgcgaaccaggccaccguccugaugggccuggggaagggcuggccccucuccaagauggacaucggggugccgcugcuggccaucggcugcugcagccaggugaaccccaucacccucacggccgcccuguuccugcucgucgcgcacuacgccaucaucgggcccggccugcaggccaaggccacccgcgaggcgcagaagcgcgccgccgccggcaucaugaagaaccccaccguggacgggaucaccgugaucgaccuggacccgauccccuacgaccccaaguucgagaagcagcucggccaggucaugcugcuggugcucugcgugacgcagguccugaucaugcggaccaccugggcccugugcgaggcgcucacccuggccacggggcccguguccacccugugggagggcaacccggggcgcuucuggaacaccaccaucgccgugagcauggccaacaucuuccggggcuccuaccucgccggcgcggggcugcuguucugcaucaugaacaacacgacccgccuccggcgcggcaccgggcaccuccggaagacccugggcgacaagugcaagagccgccucaacacgcugggcaaguccgaguuccagaucuacaagaaguccgggauccaggaggucgaccggacccuggccaaggagggcaucaagcgcggggagaccgaccaccacgccgugucccggggcagcgccaagcuccgcugguucguggagcggaaccuggucacccccgaggggaaggugguggaccugggcugcggccgcgggggcugguccuacuacugcgggggccucaagaacguccgggaggugaaggggcugacgaagggcggccccgggcacgaggagcccaucccgaugagcaccuacggcuggaaccuggugcgccuccaguccggggucgacguguucuucaucccgcccgagaagugcgacacccugcugugcgacaucggcgagagcucccccaacccgaccguggaggccgggcggacccuccgcguccugaaccugguggagaacuggcugaacaacaacacgcaguucugcaucaaggugcucaaccccuacaugcccagcgucaucgagaagauggagacccugcagcggaaguacggcggcgcgcuggugcgcaacccgcucagccgcaacuccacccacgagauguacugggugagcaacgccuccgggaacaucgucagcuccgugaacaugaucagccggaugcugaucaaccgcuucaccaugcggcacaagaaggccacguacgagcccgacguggaccugggcuccgggacccgcaacaucggcaucgagagcgagacccccaaccucgacaucaucgggaagcggaucgagaagaucaagcaggagcacgagaccuccuggcacuacgaccaggaccaccccuacaagacgugggccuaccacggcagcuacgagaccaagcagaccggcuccgcgagcuccauggucaacgggguggugcgccugcugaccaagccgugggacgucgugcccauggugacgcagauggccaugaccgacaccacccccuucggccagcagcgggucuucaaggagaagguggacacgcgcacccaggagcccaaggaggggaccaagaagcucaugaagaucaccgccgaguggcuguggaaggagcugggcaagaagaagacgccgcggaugugcacccgcgaggaguucaccaagaaggugcggagcaacgccgcccucggcgcgaucuucaccgacgagaacaaguggaaguccgcccgcgaggccgucgaggacgggcgguucugggagcugguggacaaggagcgcaaccugcaccucgagggcaagugcgagacgugcgucuacaacaugauggggaagcgggagaagaagcugggcgaguucgggaaggccaagggcagccgcgccaucugguacauguggcugggcgcgcgguuccucgaguucgaggcccugggguuccugaacgaggaccacugguucucccgcgagaacagccucuccggcguggagggggagggccugcacaagcugggguacauccuccgggaggugagcaagaaggagggcggcgccauguacgccgacgacaccgccgggugggacacccgcaucaccaucgaggaccugaagaacgaggagaugaucacgaaccacauggcgggcgagcacaagaagcuggccgaggccaucuucaagcucaccuaccagaacaaggucgugcgggugcagcgccccacgccccgggggaccgucauggacaucaucagccggcgcgaccagcggggcuccggccagguggggacguacggccugaacaccuucaccaacauggaggcccagcugauccgccagauggagggggagggcaucuucaagagcauccagcaccucaccgcgacggaggagaucgccgugcaggacuggcuggcccgggucgggcgcgagcggcugucccgcauggccaucagcggcgacgacugcguggugaagccccucgacgaccgguucgcccgcgcgcugaccgcccugaacgacaugggcaagguccggaaggacauccagcagugggagccgucccgcggguggaacgacuggacccaggugcccuucugcagccaccacuuccacgagcucaucaugaaggacggccggacccuggugguccccugccgcaaccaggacgagcugaucgggcgggcccgcaucucccagggcgccggguggagccuccgggagaccgccugccugggcaaguccuacgcgcagauguggagccugauguacuuccaccgccgggaccuccgccuggccgccaacgccaucugcuccgccgugcccagccacugggugccgacgucccgcaccaccuggagcauccacgcgucccacgaguggaugaccacggaggacaugcugaccgucuggaaccggguguggauccaggagaaccccuggauggaggacaagacccccguggagagcugggaggagauccccuaccucggcaagcgcgaggaccaguggugcgggucccugaucggccugaccagccgggccacgugggccaagaacauccagaccgccaucaaccagguccgcagccucaucgggaacgaggaguacaccgacuacaugccguccaugaagcgguuccgccgggaggaggaggaggccggcgugcugugguga

SEQ ID NO: 9697 - RNA, 9876 nt, Artificial Sequence
  derived and/or modified CDS sequence (opt1) from DENV-2__KU517845__SS-prME
accgccgggaucaucaucaugaugauccccaccgugaucgccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcgccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcgcagcggaucgagaccuggguccuccgccaccccggguucaccaucauggccgccauccuggccuacaccaucggcaccaccuacuuccagcgggugcugaucuucauccuccugaccgcggugacccccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucauggccggggacaucaagggcaucaugcaggcggggaagcggagccuccgcccgcagcccacggagcugaaguacuccuggaaggccuggggcaaggccaagaugcugagcaccgagcuccacaaccacaccuuccugaucgacggccccgagaccgccgagugcccgaacacgaaccgggccuggaacucccuggagguggaggacuacggguucggcguguucaccaccaacaucuggcucaagcugaaggagcgccaggacgcguucugcgacagcaagcugauguccgccgccaucaaggacaaccgggccauccacgccgacaugggguacuggaucgagagcgcgcucaacgacaccuggaagaucgagaaggccuccuucaucgaggucaagagcugccacuggcccaagucccacacgcuguggagcaacggcgugcuggaguccgagaugaucauccccaagaacuucgccggccccgugagccagcacaacuaccgcccgggguaccacacccagaccgccggccccuggcaccucgggcggcuggagauggacuucgacuucugcgagggcaccaccgucguggugacggaggacugcgggaaccgcggccccagccugcggaccaccaccgcguccggcaagcucaucacggaguggugcugccgcagcugcacccugcccccgcugcgguaccgcggggaggacggcugcugguacgggauggagauccggccccucaaggagaaggaggagaaccuggucaacucccuggugaccgccggccacgggcagaucgacaacuucagccucggcgugcugggcauggcccuguuccucgaggagaugcugcgcacccgggucgggacgaagcacgccauccugcucguggccguguccuucgucacccugaucaccggcaacaugagcuuccgcgaccuggggcgcgugauggugauggucggcgcgaccaugacggacgacaucgggaugggcgugaccuaccucgcccugcuggccgccuucaaggugcggcccaccuucgccgcgggccuccugcugcgcaagcucaccuccaaggagcugaugaugacgaccaucgggaucguccugcucagccaguccaccauccccgagaccauccuggagcugacggacgcccucgcccugggcaugauggugcugaagaucgugcggaacauggagaaguaccagcucgccgucaccaucauggccauccugugcgugccgaacgcggucauccugcagaacgccuggaaggugagcugcaccacccucgccguggucuccgugagcccccugcugcucacguccagccagcagaaggccgacuggaucccccuggugcugaccaucaaggggcucaaccccaccgcgaucuuccugaccacgcugucccgcaccagcaagaagcgguccuggccgcucaacgaggccaucauggccgucggcauggugagcauccuggccuccagccugcucaagaacgacauccccaugaccggcccccugguggccgggggccugcucaccgucugcuacgugcugacggggcgcagcgcggaccuggagcucgagcgggccgccgacgugcgcugggaggagcaggccgagaucuccggcagcucccccauccugagcaucaccgucuccgaggacgggagcauguccaucaagaacgaggaggaggagcagacccugaccauccucauccggacgggccugcuggugaucagcggccucuucccgguguccauccccaucaccgccgcggccugguaccugugggaggucaagaagcagcgcgccggggugcugugggacgugcccagcccgccgcccgucggcaaggccgagcucgaggacggggccuaccggaucaagcagaagggcauccugggguacucccagaucggcgcgggcguguacaaggaggggaccuuccacaccauguggcacgugacccgcggcgccguccugaugcacaaggggaagcggaucgagcccagcugggccgacgugaagaaggaccucaucuccuacggcgggggcuggaagcuggagggcgaguggaaggagggggaggaggugcagguccuggcccucgagcccggcaagaacccccgcgccgugcagacgaagcccgggcuguucaagaccaacaccggcaccaucggggcggugagccuggacuucucccccggcacgagcggcucccccaucgucgacaagaaggggaagguggugggccucuacgggaacggcgucgugacccggagcggcaccuacguguccgccaucgcccagaccgagaaguccaucgaggacaaccccgagaucgaggacgacaucuuccgcaagaagcggcugacgaucauggaccugcaccccggggccggcaagaccaagcgcuaccugcccgcgaucguccgggaggccaucaagcgcgggcuccggacccugauccuggccccgacccgcgugguggccgccgagauggaggaggcgcuccgcggccugcccauccgguaccagacgcccgccauccgcgccgagcacaccgggcgggagaucgucgaccugaugugccacgccaccuucaccaugcgccuccugagccccauccgggugccgaacuacaaccugaucaucauggacgaggcccacuucacggaccccgcguccaucgccgcccgcggcuacaucagcacccggguggagaugggcgaggccgccgggaucuucaugaccgcgacgccgcccggcucccgcgacccguucccccagagcaacgcccccaucauggacgaggagcgggagauccccgagcgcuccuggaacagcgggcacgagugggucacggacuucaagggcaagaccgugugguucgugccguccaucaaggccgggaacgacaucgccgcgugccuccggaagaacggcaagaaggucauccagcugagccgcaagaccuucgacuccgaguacaucaagacccggacgaacgacugggacuucguggugaccaccgacaucagcgagaugggcgccaacuucaaggccgagcgcgucaucgacccccggcgcugcaugaagcccgugauccugaccgacggggaggagcgggugauccucgccggccccaugccggucacgcacuccagcgccgcgcagcgccgggggcgcgugggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgccaucgacggcgaguaccgccugcgcggggaggcccgcaagaccuucgucgaccugaugcggcgcggcgaccuccccguguggcuggcguaccgggucgccgccgaggggaucaacuacgccgaccgccgguggugcuucgacggcgugaagaacaaccagauccuggaggagaacguggaggucgagaucuggaccaaggagggggagcgcaagaagcucaagccgcgguggcuggacgcccgcaucuacagcgacccccuggcgcucaaggaguucaaggaguucgccgccggccggaagucccugacgcugaaccucaucaccgagaugggccgccugcccaccuucaugacccagaaggcccggaacgcgcuggacaaccucgccgugcugcacacggccgaggccgggggccgcgccuacaaccacgcgcugagcgagcuccccgagacccuggagacccugcuccugcugacccuccuggccacggugaccgggggcaucuuccuguuccucauguccggcaaggggaucggcaagaugacccuggggaugugcugcaucaucaccgccagcauccugcucugguacgcccagauccagccgcacuggaucgccgcguccaucauccuggaguucuuccugaucguccuccugauccccgagcccgagaagcagcggacgccccaggacaaccagcugacguacguggugaucgccauccucaccgucguggccgccaccauggccaacgagaugggcuuccuggagaagaccaagaaggacuucgggcugggcagcaucgcgaaccagcagccggagagcaacauccucgacaucgaccugcgccccgccuccgccuggacgcuguacgccguggccaccaccuucaucacccccaugcuccggcacagcaucgagaacuccagcgucaacgugucccugacggcgaucgccaaccaggccaccgugcugaugggccucgggaagggcuggccccugagcaagauggacaucggggucccgcugcucgccaucggcugcuacucccaggugaaccccaucacccugaccgcggcccugcuccugcugguggcccacuacgccaucaucgggcccggccuccaggccaaggcgacgcgcgaggcccagaagcgggccgccgccggcaucaugaagaaccccaccgucgacgggaucaccgugaucgaccuggacccgauccccuacgaccccaaguucgagaagcagcugggccaggugaugcuccugguccugugcgugacccaggugcucaugaugcgcacgaccugggcgcugugcgaggcccugacccucgccaccgggcccaucagcacgcugugggagggcaacccggggcgcuucuggaacaccaccaucgccgucuccauggccaacaucuuccggggcagcuaccuggcgggcgccgggcuccuguucuccaucaugaagaacaccgccaacacgcgccggggcaccgggaacaccggcgagacccugggcgagaaguggaagaaccgccucaacgcccugggcaagagcgaguuccagaucuacaagaaguccggcauccaggagguggaccggacgcuggcgaaggaggggaucaagcgcggcgagaccgaccaccacgccgugagccggggguccgccaagcuccgcugguucgucgagcggaaccuggugacccccgagggcaagguggucgaccugggcugcgggcgcggcggguggagcuacuacugcggcgggcucaagaacgugaaggaggugaagggccugaccaagggcgggcccggccacgaggagcccaucccgauguccacguacggguggaaccugguccggcuccagagcggcguggacguguucuucacgccgcccgagaagugcgacacccugcugugcgacaucggggaguccagccccaacccgaccgucgaggccggccgcacgcuccgggugcugaaccugguggagaacuggcucaacaacaacacccaguucugcaucaagguccugaaccccuacaugcccagcgugaucgagaagauggaggcccugcagcgcaaguacggcggggcgcuggugcggaacccgcucucccgcaacagcacccacgagauguacugggucuccaacgccagcggcaacaucguguccagcgugaacaugaucucccggaugcugaucaaccgcuucaccaugcggcacaagaaggccaccuacgagcccgacgucgaccuggggagcggcacgcgcaacaucgggaucgaguccgagacccccaaccucgacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgugguccggcugcugaccaagccgugggacgugauccccauggugacccagauggcgaugacggacaccacccccuucgggcagcagcgcgucuucaaggagaagguggacacccggacgcaggagcccaaggagggcaccaagaagaucaugaagaucaccgccgaguggcucuggaaggagcugggcaagaagaagaccccgcgcaugugcacgcgggaggaguucacccgcaagguccgguccaacgccgcccugggggccaucuucaccgacgagaacaaguggaaguccgcgcgcgaggccguggaggacuccggcuucugggagcucguggacaaggagcggaaccugcaccuggaggggaagugcgagaccugcgucuacaacaugaugggcaagcgcgagaagaagcucggggaguucggcaaggccaagggcagccgggccaucugguacauguggcugggggcgcgcuuccuggaguucgaggcccucggcuuccugaacgaggaccacugguucucccgggagaacagccugagcgggguggagggcgaggggcuccacaagcugggcuacauccugcgcgacguguccaagaaggagggcggggccauguacgccgacgacacggccggcugggacacccggaucacccucgaggaccugaagaacgaggagauggucaccagccacaugaagggggagcaccgcaagcuggcggaggccaucuucaagcucacguaccagaacaagguggugcggguccagcgccccacgccccggggcaccgugauggacaucaucucccgccgggaccagcgcgggagcggccagguggucaccuacggccugaacacguucaccaacauggaggcccagcugauccgccagauggagggggagggcguguucaaguccauccagcagcucaccgugaccgaggagaucgccgucaagaacuggcuggugcggguggggcgcgagcggcugagccgcauggccaucuccggcgacgacugcgucgugaagccccucgacgaccgguucgcgagcgcccugacggcccugaacgacaugggcaaggugcgcaaggacauccagcagugggagccgucccggggguggaacgacuggacccagguccccuucugcagccaccacuuccacgagcucaucaugaaggacggccgcgugcuggugguccccugccggaaccaggacgagcugaucgggcgcgcccggaucucccagggcgccggguggagccuccgcgagaccgcgugccugggcaaguccuacgcccagauguggagccugauguacuuccaccggcgcgaccuccggcuggccgccaacgccaucugcuccgcggugcccagccacugggugccgaccucccgcacgaccuggagcauccacgccacccacgaguggaugaccaccgaggacaugcugacggucuggaaccggguguggauccaggagaaccccuggauggaggacaagacccccguggagagcugggaggagauccccuaccucggcaagcgcgaggaccaguggugcgggucccugaucggccugaccagccgggccaccugggccaagaacauccagacggcgaucaaccagguccgcucccucaucgggaacgaggaguacaccgacuacaugccgagcaugaagcgcuuccggcgcgaggaggaggaggccggcgugcugugguga

SEQ ID NO: 9698 - RNA, 9876 nt, Artificial Sequence
  derived and/or modified CDS sequence (opt1) from DENV-2__KU517847__SS-prME
accgccgggaucaucaucaugaugauccccaccgugauggccuuccaccugaccacccgcaacggggagccccacaugaucgugagccggcaggagaagggcaagagccuccuguucaagaccgagaacggggugaacaugugcacccugauggcgauggaccucggggagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccaccuacuuccagcgggugcugaucuucauccuccugaccgccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccugaccgagaacgaggucaagcugacgaucaugaccggggacaucaagggcaucaugcaggccgggaagcggucccuccgcccgcagcccaccgagcugaaguacagcuggaaggcguggggcaaggccaaggugcuguccaccgagcuccacaaccacacguuccugaucgacggccccgagaccgccgagugcccgaacaccaaccgggccuggaacagccuggagguggaggacuacggguucggcgucuucaccacgaacaucuggcucaagcugaaggagcgccaggacguguccugcgacagcaagcugauguccgccgcgaucaaggacaaccgggccgugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcacgaccgucguggugaccgagaacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggucaacucccuggugacggccggccacgggcagaucgacaacuucagccucggcgugcugggcauggcgcuguuccucgaggagaugcugcgcacccgggucgggaccaagcacgccauccugcucguggccguguccuucgucacccugaucacgggcaacaugagcuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccuccaaggagcugaugaugaccaccaucgggaucguccugcucagccaguccacgauccccgagaccauccuggagcugaccgacgcccucgcgcugggcaugauggugcugaagaucguccggaacauggagaaguaccagcucgccgugaccaucauggccauccugugcgugccgaacgccgucauccugcagaacgccuggaaggugagcugcacggcgcucgccguggucuccgugagcccccugcugcucaccuccagccagcagaagaccgacuggaucccccuggcccugaccaucaaggggcucaaccccacggccaucuuccugaccacccugucccgcaccagcaagaagcgguccuggccgcucaacgaggcgaucauggccgugggcauggucagcauccuggccuccagcuuccugaagaacgacauccccaugacgggcccccucguggccgggggccugcugaccgugugcuacguccucaccgggcgcagcgccgaccuggagcuggagcgggcggccgacauccgcugggaggagcaggccgagaucuccggcagcucccccauccucagcaucaccaucuccgaggacgggagcauguccaucaagaacgaggaggaggagcagacgcugaccauccugauccggaccggccuccuggugaucagcggccuguucccggccuccauccccaucaccgccgcggccugguaccucugggaggugaagaagcagcgcgccgggguccugugggacgugcccagcccgccgcccgugggccgggccgagcuggaggacggggccuaccgcaucaagcagaagggcauccucggguacucccagaucggcgcgggcgucuacaaggaggggaccuuccacacgauguggcacgugacccggggcgccgugcugaugcacaaggggaagcgcaucgagcccagcugggccgacgucaagaaggaccugaucuccuacggcgggggcuggaagcucgagggcgaguggaaggagggggaggagguccaggugcuggcccuggagcccggcaagaacccccgggccguccagaccaagcccggccuguucaagaccaacacgggcaccaucggggcggugagccuggacuucucccccggcaccagcggcucccccaucguggacaagaaggggaaggucgugggccuguacgggaacggcguggucacccgcagcggcacguacguguccgccaucgcccagaccgagaaguccaucgaggacaaccccgagaucgaggacgacaucuuccggaagaagcgccucaccaucauggaccugcaccccggggccggcaagaccaagcgguaccugcccgcgaucgugcgcgaggccaucaagcgggggcugcgcacgcucauccuggccccgacccgcgucguggccgccgagauggaggaggcgcugcggggccuccccauccgcuaccagacccccgccauccgggccgagcacaccgggcgcgagaucguggaccugaugugccacgccacguucaccaugcggcugcucagccccauccgcgucccgaacuacaaccugaucaucauggacgaggcccacuucaccgaccccgcguccaucgccgcccggggcuacaucagcacccgcguggagaugggcgaggccgccgggaucuucaugacggcgacgccgcccggcucccgggacccguucccccagagcaacgcccccaucauggacgaggagcgcgagauccccgagcgguccuggaacagcgggcacgagugggugaccgacuucaagggcaagaccgucugguucgugccguccaucaaggccgggaacgacaucgccgcgugccugcgcaagaacggcaagaaggugauccagcucagccggaagacguucgacuccgaguacaucaagacccgcaccaacgacugggacuucgucgugaccacggacaucagcgagaugggcgccaacuucaaggccgagcgggugaucgacccccgccggugcaugaagcccgucauccugaccgacggggaggagcgcgugauccuggccggccccaugccggugacccacuccagcgccgcgcagcggcgcgggcgcgucggccggaaccccaagaacgagaacgaccaguacaucuacaugggggagccccucgagaacgacgaggacugcgcccacuggaaggaggccaagaugcugcuggacaacaucaacacccccgagggcaucaucccguccauguucgagcccgagcgcgagaagguggacgccaucgacggcgaguaccggcuccgcggggaggcccggaagacguucguggaccugaugcgccggggcgaccugcccgucuggcucgcguaccgcguggccgccgaggggaucaacuacgccgaccggcgcuggugcuucgacggcgucaagaacaaccagauccuggaggagaacguggagguggagaucuggaccaaggagggggagcggaagaagcugaagccgcgcuggcucgacgcccggaucuacagcgacccccuggcgcugaaggaguucaaggaguucgccgccggccgcaagucccucacccugaaccugaucaccgagaugggccggcuccccacguucaugacccagaaggcccgcaacgcgcuggacaaccuggccguccuccacaccgccgaggccgggggccgggccuacaaccacgcgcugagcgagcugcccgagacccucgagacgcugcugcuccugacccugcucgccaccgugaccgggggcaucuuccuguuccugauguccggcaaggggaucggcaagaugacccucgggaugugcugcaucgugacggccagcauccugcugugguacgcccagauccagccgcacuggaucgccgcguccaucauccucgaguucuuccugaucguccugcucauccccgagcccgagaagcagcgcacgccccaggacaaccagcugaccuacguggugaucgccauccugaccgucguggccgccacgauggccaacgagaugggcuuccucgagaagaccaagaaggacuucgggcugggcagcaucaccacccagcagccggagagcaacauccuggacaucgaccuccggcccgcguccgccuggacgcuguacgccguggccaccaccuucaucacccccaugcugcgccacagcaucgagaacuccagcgucaacgugucccucacggccaucgcgaaccaggccaccgugcugaugggccuggggaagggcuggccccucagcaagauggacaucggggucccgcugcuggccaucggcugcuacucccaggugaaccccaucacccucaccgccgcgcugcugcuccugguggcccacuacgccaucaucgggcccggccugcaggccaaggccacgcgggaggcgcagaagcgcgccgccgccggcaucaugaagaaccccaccgucgacgggaucaccgugaucgaccucgacccgauccccuacgaccccaaguucgagaagcagcugggccaggugaugcugcucguccugugcgugacccaggugcugaugaugcgcacgaccugggcccucugcgaggcgcugacccuggccaccgggcccaucagcacgcucugggagggcaacccggggcgguucuggaacaccaccaucgccgucuccauggccaacaucuuccgcggcagcuaccuggccggcgcggggcuccucuucuccaucaugaagaacaccgccaacacgcggcgcggcaccgggaacaccggcgagacccugggcgagaaguggaagaaccggcugaacgcccucggcaagagcgaguuccagaucuacaagaaguccggcauccaggagguggaccgcacgcuggccaaggaggggaucaagcggggcgagaccgaccaccacgcggugagccgcggguccgccaagcugcggugguucgucgagcgcaaccucgugacccccgagggcaagguggucgaccugggcugcgggcggggcggguggagcuacuacugcggcgggcugaagaacgugaaggaggugaagggccucaccaagggcgggcccggccacgaggagcccaucccgauguccacguacggguggaaccugguccgccugcagagcggcguggacguguucuucacgccgcccgagaagugcgacacccuccugugcgacaucggggaguccagccccaacccgaccgucgaggccggccggacccugcgcgugcucaaccugguggagaacuggcugaacaacaacacgcaguucugcaucaagguccucaaccccuacaugcccagcgugaucgagaagauggaggcccugcagcggcgcuacggcggggcccuggugcggaacccgcccucccgcaacagcacccacgagauguacugggucuccaacgcgagcggcaacaucguguccagcgugaacaugaucucccggaugcugaucaaccgcuucaccaugcgccacaagaaggccaccuacgagcccgacgucgaccucgggagcggcacgcggaacaucgggaucgaguccgaggugcccaaccuggacaucaucggcaagcgcaucgagaagaucaagcaggagcacgagaccagcuggcacuacgaccaggaccacccguacaagaccugggccuaccacggcuccuacgagaccaagcagacggggagcgccuccagcauggugaacggcgucgugcggcugcucaccaagcccugggacgugauccccauggucacccagauggccaugaccgacacgacccccuucgggcagcagcgcguguucaaggagaaggucgacacccggacccaggagccgaaggagggcacgaagaagcugaugaagaucaccgcggaguggcuguggaaggagcucggcaagaagaagacgccccgcaugugcacccgggaggaguucacgcgcaaggugcgguccaacgccgcccugggggccaucuucaccgacgagaacaaguggaaguccgcccgcgaggcgguggaggacuccggcuucugggagcuggucgacaaggagcggaaccuccaccuggaggggaagugcgagaccugcguguacaacaugaugggcaagcgcgagaagaagcugggggaguucggcaaggccaagggcagccgggccaucugguacauguggcucggggcccgcuuccuggaguucgaggcgcugggcuuccucaacgaggaccacugguucucccgggagaacagccugagcgggguggagggcgaggggcugcacaagcucggcuacauccugcgcgacgucuccaagaaggagggcggggccauguacgccgacgacaccgccggcugggacacgcggaucacccuggaggaccucaagaacgaggagauggugaccaaccacauggagggggagcacaagaagcuggccgaggcgaucuuccgccugaccuaccagaacaaggugguccgggugcagcgccccacgccccggggcaccgugauggacaucaucagccgccgcgaccagcggggguccggccaggucgugaccuacggccucaacaccuucacgaacauggaggcccagcugauccgccagauggagggggagggcguguucaagagcauccagcaccugaccgccaccgaggagaucgccgucaagaacuggcucgugcggguggggcgcgagcggcugucccgcauggccaucagcggcgacgacugcgucgugaagccguucgacgaccgguucgcgaacgcccugaccgcccucaacgacaugggcaaggugcgcaaggacauccagcagugggagcccucccggggguggaacgacuggacgcagguccccuucugcagccaccacuuccacgagcugaucaugaaggacggccgcgugcuggugguccccugccggaaccaggacgagcucaucgggcgcgcccggaucucccagggcgccggguggagccugcgcgagaccgcgugccugggcaaguccuacgcccagauguggagccucauguacuuccaccggcgcgaccugcggcuggccgccaacgccaucugcuccgcggugccgagccacugggugcccaccucccgcaccaccuggagcauccacgccacgcacgaguggaugaccaccgaggacaugcucaccgucuggaaccggguguggauccaggagaaccccuggauggaggacaagacgcccguggaguccugggaggagaucccguaccugggcaagcgcgaggaccaguggugcgggagccugaucggccucaccagccgcgccaccugggccaagaacauccagaccgcgaucaaccagguccggucccugaucgggaacgaggaguacacggacuacaugcccagcaugaagcgcuuccggcgcgaggaggaggaggccggcgugcugugguga

SEQ ID NO: 9699 - RNA, 9876 nt, Artificial Sequence
  derived and/or modified CDS sequence (opt1) from DENV-2__JQ955623__SS-prME
accgccgggaugaucaucaugcugauccccaccgccauggcguuccaccucaccacccggaacggggagccccacaugaucgugagccggcaggagaagggcaagagccugcuguucaagaccgaggacggggucaacaugugcacccucauggccauggaccugggcgagcugugcgaggacaccaucaccuacaacugcccccuccugcggcagaacgagcccgaggacaucgacugcuggugcaacagcaccuccaccugggugaccuacgggaccugcaccgccaccggcgagcaccggcgggagaagcggagcguggcccuggucccccacgugggcauggggcucgagacccgcaccgagaccuggauguccagcgagggcgccuggaagcacgcgcagcggaucgagaccuggauccugcgccaccccggguucacgaucauggccgccauccuggccuacaccaucggcaccacccacuuccagcgggugcucaucuucauccugcugacggcggucgcccccuccaugaccaugcgcugcaucgggaucagcaaccgggacuucguggagggcguguccggcgggagcugggucgacaucgugcucgagcacggcuccugcgugaccaccauggccaagaacaagcccacgcuggacuucgagcugaucaagaccgaggccaagcagcccgccacccuccgcaaguacugcaucgaggcgaagcugaccaacacgaccaccgccagccggugcccgacccagggggagcccucccugaacgaggagcaggacaagcgcuucgucugcaagcacagcaugguggaccggggcuggggcaacgggugcggccucuucgggaagggcgggaucgugacgugcgccauguucacgugcaagaagaacauggagggcaagaucguccagcccgagaaccuggaguacaccaucguggugacgccccacuccggcgaggagaacgccgucgggaacgacacgggcaagcacgggaaggagaucaaggugaccccgcagagcuccaucaccgaggccgagcugaccggcuacgggaccgugacgauggagugcagcccccgcaccggccucgacuucaacgagaugguccugcugcagauggagaacaaggcguggcucgugcaccggcagugguuccuggaccugccccuccccuggcugccgggcgccgacacccagggguccaacuggauccagaaggagacccuggugacguucaagaacccccacgccaagaagcaggacgucgugguccucggcagccaggagggggccaugcacaccgcccugaccggcgcgaccgagauccagaugagcuccgggaaccuccuguucacgggccaccugaagugccgccugcggauggacaagcuccagcugaagggcaugagcuacuccaugugcaccgggaaguucaagguggugaaggagaucgccgagacccagcacggcaccaucgucauccgcgugcaguacgagggggacggcagccccugcaagauccccuucgagaucauggaccuggagaagcggcacgugcucggccgccugaucacggucaacccgaucgugaccgagaaggacucccccgugaacaucgaggccgagccgcccuucggggacagcuacaucaucgucggcguggagccggggcagcugaagcucuccugguucaagaagggcagcuccaucgggcagauguucgagaccaccaugcgcggcgccaagcggauggccauccugggcgacacggcgugggacuucgggagccugggcgggguguucaccuccaucggcaaggcccuccaccaggucuucggggccaucuacggcgccgcguucagcggcguguccuggaccaugaagauccugaucgggguggucaucaccuggaucggcaugaacagccgcuccacgagccuguccgugagccuggugcucgucgggaucgugacccuguaccugggcgugaugguccaggccgacuccgggugcguggugagcuggaagaacaaggagcucaagugcggcagcggcaucuucaucaccgacaacguccacaccuggacggagcaguacaaguuccagcccgagucccccagcaagcuggccuccgccauccagaaggcccacgaggaggggaucugcggcauccggagcgugacccgccuggagaaccucauguggaagcagaucacccccgagcugaaccacauccuguccgagaacgaggugaagcucaccaucaugacgggggacaucaagggcaucaugcaggcggggaagcggagccugcgcccgcagcccaccgagcugaaguacuccuggaagaccuggggcaaggccaagaugcucagcaccgagccccacaaccagacguuccugaucgacggcccggagaccgccgagugccccaacaccaaccgggccuggaacucccuggaggucgaggacuacggguucggcguguucaccacgaacaucuggcucaagcugaaggagcgccaggacguguucugcgacagcaagcugauguccgccgcgaucaaggacaaccgggccguccacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggcccggugagccagcacaacuaccgccccggguaccacacccagaccgccggccccuggcaccucgggaagcuggagauggacuucgacuucugcgagggcacgaccgugguggucaccgaggacugcgggaaccggggccccagccugcgcaccacgaccgccuccggcaagcucaucaccgaguggugcugccggagcugcacccugccgccccugcgcuaccgcggggaggacggcugcugguacgggauggagauccgcccccucaaggagaaggaggagaaccuggugaacucccuggugacggccggccacgggcagaucgacaacuucagccucggcguccugggcauggcgcuguuccucgaggagaugcugcggacccgcguggggaccaagcacgccgugcugcucgucgccguguccuucaugacccugaucacgggcaacaugagcuuccgggaccuggggcgcgugauggucauggugggcgccgccaugaccgacgacaucgggaugggcgugaccuaccucgcgcugcuggccgccuucaagguccgccccaccuucgccgccggccuccugcugcggaagcucacguccaaggagcugaugaugaccaccaucgggaucgugcugcucagccaguccaccaucccggagacgauccuggagcugaccgacgcgcucgcccugggcaugaugauccugaagaucgugcgcaacauggagaaguaccagcucgccgucaccaucauggccauccugugcgugcccaacgccgucauccugcagaacgcguggaaggugagcugcaccauccucgccguggucuccgugagcccccugcugcucacguccagccagcagaaggccgacuggaucccccuggcccugaccaucaaggggcucaacccgaccgcgaucuuccugaccacgcugucccggaccaacaagaagcgcagcuggccccucaacgaggccaucauggccgugggcauggucuccauccuggccagcucccugcucaagaacgacauccccaugaccggcccccugguggccgggggccugcucaccgugugcuacguccugacggggcggagcgcggaccuggagcucgagcgcgccgccgacgugcggugggaggaccaggccgagaucagcggcuccagcccgauccuguccaucaccaucagcgaggacggguccaugagcaucaagaacgaggaggaggagcagacccugaccauccucauccgcacgggccugcuggugaucuccggccucuuccccgucagcauccccaucaccgccgcggccugguaccugugggaggugaagaagcagcgggccggggugcugugggacguccccuccccgccgcccgugggcaaggccgagcucgaggacggggccuaccgcaucaagcagaagggcauccugggguacagccagaucggcgcgggcguguacaaggaggggaccuuccacaccauguggcacgucacccggggcgccgugcugaugcacaaggggaagcgcaucgagccguccugggccgacgugcggaaggaccucaucagcuacggcgggggcuggaagcuggagggcgaguggaaggagggggaggagguccaggugcuggcccucgagcccggcaagaacccccgcgccgugcagacgaagcccgggcuguucaagaccaacaccggcaccaucggggcggucucccuggacuucagcccgggcacguccggcagccccaucguggacaagaaggggaagguggucggccucuacgggaacggcguggugacccgguccggcaccuacgucagcgccaucgcccagaccgagaaguccaucgaggacaaccccgagaucgaggacgacaucuuccgcaagaagcggcugacgaucauggaccugcaccccggggccggcaagaccaagcgcuaccugccggcgaucgugcgggaggccaucaagcgcgggcuccggacccugauccuggcccccacccgcguggucgccgccgagauggaggaggcgcuccgcggccugcccauccgguaccagacgcccgccauccgcgccgagcacaccgggcgggagaucguggaccugaugugccacgccaccuucaccaugcgccuccugagcccggugcggguccccaacuacaaccugaucaucauggacgaggcccacuucacggaccccgcgagcaucgccgcccgcggcuacaucuccacccggguggagaugggcgaggccgccgggaucuucaugaccgcgacgccgcccggcagccgcgaccccuucccccaguccaacgcccccaucauggacgaggagcgggagauccccgagcgcagcuggaacuccgggcacgagugggugacggacuucaagggcaagaccgucugguucgugcccagcaucaaggccgggaacgacaucgccgcgugccuccggaagaacggcaagaaggugauccagcugucccgcaagaccuucgacagcgaguacaucaagacccggacgaacgacugggacuucgucgugaccaccgacaucuccgagaugggcgccaacuucaaggccgagcgcgugaucgacccccggcgcugcaugaagcccgucauccugaccgacggggaggagcgggugauccucgccggcccgaugcccgugacgcacagcuccgccgcgcagcgccgggggcgcaucggccgcaaccccaagaacgagaacgaccaguacaucuacaugggggagccccuggagaacgacgaggacugcgcccacuggaaggaggccaagaugcugcucgacaacaucaacaccccggagggcaucauccccagcauguucgagcccgagcgggagaaggucgacgccaucgacggcgaguaccgccugcgcggggaggcccgcaagaccuucguggaccugaugcggcgcggcgaccucccgguguggcuggcguaccgggucgccgccgaggggaucaacuacgccgaccgccgguggugcuucgacggcaucaagaacaaccagauccuggaggagaacguggaggucgagaucuggaccaaggagggggagcgcaagaagcucaagccccgguggcuggacgcccgcaucuacuccgacccccuggcgcucaaggaguucaaggaguucgccgccggccgcaagagccugacgcugaaccucaucaccgagaugggccgccugcccaccuucaugacccagaaggcccggaacgcgcuggacaaccucgccgugcugcacacggccgaggccgggggccgcgccuacaaccacgcgcuguccgagcucccggagacccuggagacccugcuccugcugacccuccuggccacggugaccgggggcaucuuccuguuccucaugagcggcaaggggaucggcaagaugacccuggggaugugcugcaucaucaccgccuccauccugcucugguacgcccagauccagccccacuggaucgccgcgagcaucauccuggaguucuuccugaucguccuccugauccccgagcccgagaagcagcggaccccgcaggacaaccagcugacguacguggugaucgccauccucaccgucguggccgccaccauggccaacgagaugggcuuccuggagaagaccaagaaggacuucgggcugggcuccaucgcgacgcagcagcucgagagcaacauccuggacaucgaccugcgccccgccagcgccuggacccucuacgccguggccaccaccuucaucacgcccaugcugcggcacuccaucgagaacagcuccgucaacgugagccugaccgcgaucgccaaccaggccaccgugcucaugggccuggggaagggcuggccccuguccaagauggacaucggggucccgcuccuggccaucggcugcuacagccaggugaaccccaucacccugacggcggcccuccugcugcucguggcccacuacgccaucaucgggcccggccugcaggccaaggcgacccgcgaggcccagaagcgggccgccgccggcaucaugaagaaccccaccgucgacgggaucaccgugaucgaccuggacccgauccccuacgaccccaaguucgagaagcagcucggccaggugaugcugcugguccucugcgugacccaggugcugaugaugcgcaccaccugggcgcugugcgaggcccucacccuggccacggggcccaucuccacccugugggagggcaacccggggcgcuucuggaacaccaccaucgccgucagcauggccaacaucuuccggggcuccuaccucgcgggcgccgggcugcuguucagcaucaugaagaacacgaccaacacccgccggggcaccgggaacacgggcgagacccucggcgagaaguggaagaaccgccugaacucccugggcaagagcgaguuccagaucuacaagcgguccggcauccaggagguggaccgcacccucgccaaggaggggaucaagcggggcgagaccgaccaccacgccgugagccgcggguccgcgaagcugcggugguucgucgagcgcaaccuggugacgcccgagggcaagguggucgaccucggcugcgggcggggcggguggagcuacuacugcggcgggcugaagaacgugcgcgaggugaagggccugaccaagggcgggcccggccacgaggagcccaucccgauguccaccuacggguggaaccucguccggcugcagagcggcguggacguguucuucacgccgcccgagaagugcgacacgcugcucugcgacaucggggaguccagccccaacccgaccgucgaggccggccgcacccugcgggugcugaaccucguggagaacuggcugaacaacgacacccaguucugcaucaagguccugaaccccuacaugcccagcgugaucgagaagauggaggcccugcagcgcaaguacggcggggcccucgugcggaacccgcugucccgcaacagcacccacgagauguacugggucuccaacgccagcggcaacaucguguccagcgugaacaugaucucccggaugcugaucaaccgcuucacgaugcgccacaagaaggcgaccuacgagcccgacgucgaccucgggagcggcacccggaacaucgggaucgaguccgagacccccaaccuggacaucaucggcaagcgcaucgagaagaucaagcaggagcacgagacgagcuggcacuacgaccaggaccaccccuacaagaccugggccuaccacggcuccuacgagaccaagcagaccgggagcgccuccagcauggugaacggcgugguccggcugcucacgaagccgugggacgugauccccauggugacccagauggccaugaccgacaccacgcccuucgggcagcagcgcgucuucaaggagaagguggacacccggacccaggagcccaaggagggcaccaagaagcugaugaagaucacggccgaguggcuguggaaggagcucggcaagaagaagaccccgcgcaugugcacccgggaggaguucacccgcaaggugcgguccaacgcggcccugggggccaucuucacggacgagaacaaguggaaguccgcccgcgaggccgucgaggacucccgguucugggagcuggugaacaaggagcgcaaccuccaccuggagggcaagugcgagaccugcgucuacaacaugauggggaagcgggagaagaagaucggcgaguucgggaaggcgaagggcagccgcgccaucugguacauguggcugggcgcccgguuccucgaguucgaggcccugggguuccugaacgaggaccacugguucucccgcgagaacagccucagcggcguggagggggagggccugcacaagcugggguacauccuccgggagguguccaagaaggagggcggcgcgauguacgccgacgacaccgccgggugggacacccgcaucacgcuggaggaccugaagaacgaggagauggucaccaaccacauggagggcgagcacaagaagcucgccgaggccaucuucaagcugaccuaccagaacaagguggugcggguccagcgccccacgccccgggggacggugauggacaucaucagccgccgcgaccagcggggcuccggccagguggggaccuacggccugaacaccuucaccaacaugggggcgcagcucauccgccagauggagggcgagggggucuucaagggcauccagcaccugacggccaccgaggagaccgccgugcacgacuggcuggcccgggugggccgcgagcggcucagccgcauggccaucuccggggacgacugcgucgugaagccccuggacgaccgguucgcgagcgcccugaccgcccucaacgacaugggcaaggugcgcaaggacauccagcagugggagccgucccggggguggaacgacuggacgcagguccccuucugcagccaccacuuccacgagcugaucaugaaggacggccgcgugcuggugguccccugccggaaccaggacgagcucaucgggcgcgcccggaucucccagggcgccggcuggagccugcgcgagaccgcgugccuggggaaguccuacgcccagauguggagccucauguacuuccaccggcgcgaccugcggcuggccgccaacgccaucugcuccgcggugcccagccacugggugccgaccucccgcaccaccuggagcauccacgcccggcacgaguggaugacgaccgaggacaugcucaccgucuggaaccgcguguggauccaggagaaccccuggauggaggacaagacccccguggaguccugggaggagauccccuaccugggcaagcgcgaggaccaguggugcgggagccugaucggccucacgagccgggccaccugggccaagaacauccagaccgcgaucaaccagguccgcucccugaucgggagcgaggaguacaccgacuacaugccguccaugaagcgguuccgccgggaggaggaggaggccggcgugcugugguga

SEQ ID NO: 9700 - RNA, 9876 nt, Artificial Sequence
  derived and/or modified CDS sequence (opt1) from DENV-2__KR779782__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgugauggugcaggcggacuccgggugcgucgugagcuggaagaacaaggagcugaagugcggcagcggcaucuucaucaccgacaacgugcacaccuggacggagcaguacaaguuccagcccgagucccccagcaagcucgccuccgccauccagaaggcccacgagcaggggaucugcggcauccggagcgucacccgccuggagaaccugauguggaagcagaucacccccgagcucaaccacauccugaccgagaacgaggugaagcugacgaucaugaccggggacaucaagggcaucaugcaggccgggaagcggucccuccgcccgcagcccaccgagcugaaguacagcuggaaggcguggggcaaggccaagaugcuguccaccgagcuccacaaccacacguuccugaucgacggccccgagaccgccgagugcccgaacaccaaccgggccuggaacagccuggagguggaggacuacggguucggcgucuucaccacgaacaucuggcucaagcugaaggagcgccaggacguguucugcgacuccaagcugaugagcgccgcgaucaaggacaaccgggccgugcacgccgacaugggguacuggaucgaguccgcccucaacgacaccuggaagaucgagaaggccagcuucaucgaggucaaguccugccacuggcccaagagccacacccugugguccaacggcgugcuggagagcgagaugaucauccccaagaacuucgcgggccccgugucccagcacaacuaccgcccgggguaccacacccagaccgccggccccuggcaccucgggcggcuggagauggacuucgacuucugcgagggcacgaccgucguggugaccgaggacugcgggaaccgcggccccagccugcggaccacgaccgccagcggcaagcucaucaccgaguggugcugccgcuccugcacccugcccccgcugcgguaccgcggggaggacggcugcugguacgggauggagauccggccccucaaggagaaggaggagaaccuggucaacagccuggugacggccggccacgggcagaucgacaacuucucccucggcgugcugggcauggcgcuguuccucgaggagaugcugcgcacccgggucgggaccaagcacgccauccugcucguggccgugagcuucgucacccugaucacgggcaacauguccuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccagcaaggagcugaugaugaccaccaucgggaucguccugcucucccagagcacgauccccgaguccauccuggagcugaccgacgcccucgcgcugggcaugauggugcugaagaucguccggaacauggagaaguaccagcucgccgugaccaucauggccauccugugcgugccgaacgccgucauccugcagaacgccuggaaggugagcugcaccacgcucgcgguggucuccgugagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgugggcauggucagcauccuggccuccagccugcucaagaacgacauccccaugaccggcccccugguggccgggggccugcucacggugugcuacguccugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccggucuccauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacucccagaucggcgccggcguguacaaggaggggaccuuccacaccauguggcacgucacgcgcggcgcggugcugaugcacaaggggaagcggaucgagcccagcugggccgacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagaccaacaccggcacgaucggggccgucagccuggacuucucccccggcaccagcggcucccccaucguggacaagaaggggaagguggucggccucuacgggaacggcguggugacccggagcggcaccuacgucuccgcgaucgcccagacggagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcguggucgccgccgagauggaggaggcccuccgcggccugcccauccgguaccagacccccgcgauccgcgccgagcacaccgggcgggagaucguggaccugaugugccacgccaccuucacgaugcgccuccugagccccauccgggugccgaacuacaaccugaucaucauggacgaggcccacuucaccgaccccgccuccaucgcggcccgcggcuacaucagcacccgggucgagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugaccgacuucaagggcaagaccgugugguucgucccguccaucaaggccgggaacgacaucgccgccugccuccggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccccggcgcugcaugaagcccgugauccugacggacggggaggagcgggucauccucgccggccccaugccggugacccacuccagcgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgggagaaggucgacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgugaagaacaaccagauccuggaggagaacgucgagguggagaucuggacgaaggagggggagcgcaagaagcucaagccgcgguggcuggacgcccgcaucuacagcgacccccuggcccucaaggaguucaaggaguucgcggccggccggaagucccugacccugaaccucaucaccgagaugggccgccugcccaccuucaugacgcagaaggccaagaacgcccuggacaaccucgcggugcugcacaccgccgaggccgggggccgggccuacaaccacgcccugagcgagcuccccgagacccuggagacccugcuccugcugacgcuccuggcgaccgucaccgggggcaucuuccuguuccucauguccggcaaggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugaccuacguggucaucgcgauccucaccgugguggccgccaccauggccaacgagaugggcuuccuggagaagacgaagaaggacuucgggcugggcagcaucaccacccagcagccggagagcaacauccucgacaucgaccugcggcccgccuccgcguggacccuguacgccgucgccacgaccuucaucacccccaugcuccgccacagcaucgagaacuccagcgugaacgugucccugaccgccaucgccaaccaggcgacgguccugaugggccucgggaagggcuggccccugagcaagauggacaucggggugccgcugcucgccaucggcugcuacucccaggugaaccccaucacccugaccgccgcccugcuccugcuggucgcgcacuacgccaucaucgggcccggccuccaggccaaggccacccgggaggcccagaagcgcgcggccgccggcaucaugaagaaccccacgguggacgggaugaccgugaucgaccuggacccgauccccuacgaccccaaguucgagaagcagcugggccaggucaugcuccuggugcugugcgugacccagguccucaugaugcggaccacgugggcccugugcgaggcccugacccucgcgaccgggcccaucagcacccugugggagggcaacccggggcgcuucuggaacacgaccaucgccguguccauggccaacaucuuccgcggcagcuaccuggccggcgccgggcuccuguucuccaucaugaagaacaccgcgaacacccggcgcggcacggggaacaccggcgagacccugggcgagaaguggaagaaccggcucaacgcccugggcaagagcgaguuccagaucuacaagaaguccggcauccaggagguggaccgcacccuggccaaggaggggaucaagcggggcgagacggaccaccacgccgucagccgcggguccgcgaagcuccggugguucguggagcgcaaccuggugacccccgagggcaaggucguggaccugggcugcgggcggggcggguggagcuacuacugcggcgggcucaagaacgugaaggaggucaagggccugaccaagggcgggcccggccacgaggagcccaucccgauguccaccuacggguggaaccuggugcgccuccagagcggcguggacgucuucuucacgccgcccgagaagugcgacacccugcugugcgacaucggggaguccagccccaacccgaccguggaggccggccggacccuccgcgugcugaaccuggucgagaacuggcucaacaacaacacccaguucugcaucaaggugcugaaccccuacaugcccagcgugaucgagaagauggaggcccugcagcggaaguacggcggggcccugguccgcaacccgcucucccggaacagcacgcacgagauguacuggguguccaacgccagcggcaacaucguguccagcgucaacaugaucucccgcaugcugaucaaccgguucaccaugcgccacaagaaggcgaccuacgagcccgacguggaccuggggagcggcacccggaacaucgggaucgaguccgagacgcccaaccucgacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcugaccaagccgugggacgugauccccauggucacccagauggccaugaccgacacgacccccuucgggcagcagcggguguucaaggagaaggucgacacccgcacccaggagcccaaggagggcacgaagaagcucaugaagaucaccgccgaguggcuguggaaggagcugggcaagaagaagaccccgcggaugugcacccgcgaggaguucacgcggaaggugcgcuccaacgcggcccucggggccaucuucaccgacgagaacaaguggaaguccgcccgggaggccguggaggacuccggcuucugggagcuggucgacaaggagcgcaaccugcaccucgaggggaagugcgagaccugcguguacaacaugaugggcaagcgggagaagaagcugggggaguucggcaaggcgaagggcagccgcgccaucugguacauguggcugggggcccgguuccucgaguucgaggcccugggcuuccugaacgaggaccacugguucucccgcgagaacagccucagcgggguggagggcgaggggcugcacaagcugggcuacauccuccgggacgucuccaagaaggagggcggggcgauguacgccgacgacaccgccggcugggacacgcgcaucacccuggaggaccugaagaacgaggagauggugaccaaccacauggagggggagcacaagaagcucgccgaggccaucuucaagcugaccuaccagaacaaggugguccgggugcagcgccccacgccccggggcaccgugauggacaucaucagccgccgggaccagcgcggguccggccaggucgugaccuacggccugaacaccuucacgaacauggaggcgcagcucauccggcagauggagggggagggcguguucaagagcauccagcagcugaccgucaaggaggagaucgccgugaagaacuggcugauccgcguggggcgcgagcggcucucccgcauggccaucagcggcgacgacugcgucgugaagccccuggacgaccgguucgccuccgcccugaccgcgcucaacgacaugggcaaggugcgcaaggacauccagcagugggagccgagccggggguggaacgacuggacccagguccccuucugcucccaccacuuccacgagcugaucaugaaggacggccgcgugcuggugguccccugccggaaccaggacgagcucaucgggcgcgcccggaucagccagggcgccggguggucccugcgcgagacggccugccugggcaagagcuacgcccagauguggucccucauguacuuccaccggcgcgaccugcggcuggcggccaacgccaucugcagcgccgugcccucccacugggugccgaccagccgcaccaccugguccauccacgccacccacgaguggaugacgaccgaggacaugcucaccgucuggaaccggguguggauccaggagaaccccuggauggaggacaagacccccguggagagcugggaggagauccccuaccugggcaagcgcgaggaccaguggugcgggagccugaucggccucacgucccgggcgaccugggccaagaacauccagaccgccaucaaccagguccgcagccugaucgggaacgaggaguacaccgacuacaugccguccaugaagcgguuccgccgcgaggaggaggaggccggcgugcugugguga

SEQ ID NO: 9701 - RNA, 9876 nt, Artificial Sequence
  derived and/or modified CDS sequence (opt1) from DENV-2__KM279608__SS-prME
accgccggcaucaucaucaugaugauccccaccgugauggccuuccaccugaccacccggaacggggagccccacaugaucgugagccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugacguacgggaccugcaccgucaccggcgagcaccggcgcgagaagcggagcguggcccuggugccccacgucggcauggggcuggagacgcgcaccgagaccuggauguccagcgagggcgccuggaagcacgcccagcggaucgagaccuggauccuccgccaccccggguucacgaucauggccgcgauccuggccuacaccaucggcaccaccuaccugcagcgggugcucaucuucauccugcugacggccgugacccccuccauggccaugcgcugcaucgggaucagcaaccgggacuucgucgagggcguguccggcgggagcuggguggacaucguccucgagcacggcuccugcgugaccaccauggcgaagaacaagcccacgcuggacuucgagcugaucaagaccgaggccaagcaccccgccacccuccgcaaguacugcguggaggccaagcugaccaacacgaccaccgccagccggugcccgacccagggggagcccucccugaacgaggagcaggacaagcgcuucgucugcaagcacagcaugguggaccggggcuggggcaacgggugcggccucuucgggaagggcgggaucgugacgugcgcgauguucacgugcaagaagaacauggagggcaaggucgugcagcccgagaaccuggaguacaccaucgugaucacgccccacuccggcgaggagaacgccgucgggaacgacacgggcaagcacgggaaggagaucaaggugaccccgcagagcuccaucaccgaggccgagcugaccggcuacgggaccgugacgauggagugcagcccccgcaccggccucgacuucaacgagaugguccugcugcagauggagaacaaggccuggcucgugcaccggcagugguuccuggaccugccccuccccuggcugccgggcgccgacacccagggguccaacuggauccagaaggagacccuggucacguucaagaacccccacgcgaagaagcaggacguggugguccucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaagguggugaaggagaucgccgagacccagcacggcaccaucgucauccgcgugcaguacgagggggacggcagccccugcaagauccccuucgagaucauggaccuggagaagcggcacgugcucggccgccugaucacggucaacccgaucgugaccgagaaggacaaccccgugaacaucgaggcggagccgcccuucggggacuccuacaucaucaucggcgucgagccggggcagcugaagcucagcugguacaagaagggcuccagcaucgggcagauguucgagaccaccaugcgcggcgccaagcggauggccauccugggcgacacggccugggacuucgggucccugggcgggguguucaccagcaucggcaaggcccuccaccagguguucggggcgaucuacggcgccgccuucuccggcgucagcuggaccaugaagauccugaucgggguggugaucaccuggaucggcaugaacucccgcagcacgucccugagcgucucccuggugcucgugggggucgugacccuguaccugggcgugaugguccaggccgacagcgggugcgugguguccuggcggaacaaggagcucaagugcggcagcggcaucuucaucaccgacaacguccacaccuggacggagcaguacaaguuccagcccgagagccccuccaagcuggcgagcgccauccagaaggcccacgaggaggggaucugcggcauccgcuccgugacccggcuggagaaccucauguggaagcagaucacccccgagcugaaccacauccugaccgagaacgaggugaagcucacgaucaugaccggggacaucaagggcaucaugcaggccgggaagcgcagccugcggccgcagcccaccgagcugaaguacuccuggaaggccuggggcaaggcgaagaugcucagcaccgagcugcacaaccacacguuccugaucgacggccccgagaccgccgagugcccgaacaccaaccgcgccuggaacucccucgaggucgaggacuacggguucggcguguucaccacgaacaucuggcugaagcugaaggagcggcaggacguguucugcgacagcaagcucauguccgccgccaucaaggacaaccgcgcgguccacgccgacaugggguacuggaucgagagcgcccugaacgacaccuggaagaucgagaaggccuccuucaucgaggucaagagcugccacuggcccaagucccacacccuguggagcaacggcgugcucgaguccgagaugaucauccccaagaacuucgccggccccgugagccagcacaacuaccggccgggguaccacacccagaccgcgggccccuggcaccuggggcgccuggagauggacuucgacuucugcgagggcacgaccgugguggucaccgaggacugcgggaaccggggccccucccuccgcaccacgaccgccagcggcaagcugaucaccgaguggugcugccggagcugcacccugcccccgcuccgcuaccgcggggaggacggcugcugguacgggauggagauccgcccccugaaggagaaggaggagaaccuggugaacucccucgugacggccggccacgggcagaucgacaacuucagccugggcguccugggcauggcccucuuccuggaggagaugcugcggacccgcguggggaccaagcacgcgauccuccugguggccgucuccuucgugacccugaucacgggcaacaugagcuuccgcgaccucgggcgggugauggucauggugggcgccaccaugaccgacgacaucgggaugggcgugaccuaccuggcccugcucgccgcguucaagguccgccccacguucgccgccggccugcugcuccggaagcugaccuccaaggagcugaugaugaccaccaucgggaucgugcuccugagccaguccacgauccccgagagcauccuggagcucaccgacgcccuggcccugggcaugaugguccucaagaucgugcgcaacauggagaaguaccagcuggcggugaccaucauggccauccugugcgucccgaacgccgugauccucgagaacgccuggaagguguccugcaccacgcuggccgucgugagcgugagcccccugcuccugaccagcucccagcagaaggcggacuggaucccccuggcccucaccaucaaggggcugaaccccaccgccaucuuccugacgacccucagccggaccuccaagaagcgcagcuggccgcugaacgaggccaucauggcggucggcaugguguccauccuggccagcucccuccugaagaacgacauccccaugaccggcccccugguggccgggggccuccugacggucugcuacgugcugaccgggcggagcgccgaccucgagcuggagcgcgccgcggacgugcggugggaggagcaggccgagaucagcggcuccagccccauccuguccaucaccaucagcgaggacggguccaugagcaucaagaacgaggaggaggagcagacccucacgauccugauccgcaccggccugcucgucaucuccggccuguucccggugagcauccccaucaccgccgccgccugguaccugugggaggugaagaagcagcgggcggggguccucugggacgugcccagcccgccgcccgugggcaaggccgagcuggaggacggggccuaccgcaucaagcagaagggcauccugggguacagccagaucggcgccggcgucuacaaggaggggaccuuccacaccauguggcacgugacgcggggcgccgugcucaugcacaaggggaagcgcaucgagcccuccugggcggacgucaagaaggaccugaucagcuacggcgggggcuggaagcuggagggcgaguggaaggagggggaggagguccaggugcucgcccuggagcccggcaagaacccccgggccguccagaccaagcccgggcuguucaagaccaacaccggcacgaucggggccgugucccucgacuucagccccggcaccuccggcagccccaucguggacaagaaggggaaggucgugggccuguacgggaacggcguggucacccgcuccggcaccuacgugagcgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccucgcgccgacgcgcgucguggccgccgagauggaggaggcccugcggggccugcccauccgcuaccagacccccgccauccgggcggagcacaccgggcgcgagaucguggaccucaugugccacgccaccuucacgaugcggcugcugagccccauccgcgucccgaacuacaaccucaucaucauggacgaggcccacuucaccgaccccgccagcaucgccgcgcggggcuacaucuccacccgcguggagaugggcgaggccgccgggaucuucaugaccgccacgccgcccggcagccgggacccguucccccaguccaacgcccccaucauggacgaggagcgcgagauccccgagcggagcuggaacuccgggcacgagugggugaccgacuucaagggcaagaccgucugguucgugccgagcaucaaggcggggaacgacaucgccgccugccugcgcaagaacggcaagaaggugauccagcugucccggaagaccuucgacagcgaguacaucaagacgcgcaccaacgacugggacuucgucgugaccaccgacaucuccgagaugggcgccaacuucaaggcggagcgggugaucgacccccgccggugcaugaagcccgucauccucacggacggggaggagcgcgugauccuggccggccccaugccggugacccacagcuccgccgcccagcggcgcgggcgcgucggccggaaccccaagaacgagaacgaccaguacaucuacaugggggagccccuggagaacgacgaggacugcgcccacuggaaggaggcgaagaugcuccuggacaacaucaacacccccgagggcaucaucccgagcauguucgagcccgagcgcgagaagguggacgccaucgacggcgaguaccggcugcgcggggaggcccggaagaccuucgucgaccucaugcgccggggcgaccugcccguguggcuggccuacaagguggccgcggaggggaucaacuacgccgaccgccgguggugcuucgacggcgucaagaacaaccagauccucgaggagaacguggagguggagaucuggacgaaggagggggagcgcaagaagcugaagccgcgguggcuggacgcccgcaucuacuccgacccccucgcccugaaggaguucaaggaguucgccgcgggccggaagucccugacccucaaccugaucaccgagaugggccgccugcccaccuucaugacgcagaaggccaagaacgcccucgacaaccuggccguccugcacaccgcggaggccgggggccgggccuacaaccacgcccucuccgagcugcccgagacccuggagacccuccugcugcucacgcugcuggccaccgugaccgggggcaucuuccucuuccugaugagcggcaaggggaucggcaagaugacccuggggaugugcugcaucaucaccgcguccauccuccugugguacgcccagauccagccgcacuggaucgccgccagcaucauccuggaguucuuccucaucgugcugcugauccccgagcccgagaagcagcgcacgccccaggacaaccagcucaccuacgucgugaucgccauccugaccguggucgcggccaccauggccaacgagaugggcuuccuggagaagacgaagaaggacuucgggcucggcuccaucaccacccagcagccggagagcaacauccuggacaucgaccugcggcccgccagcgccuggacccucuacgcgguggccacgaccuucaucacccccaugcugcgccacuccaucgagaacagcuccgugaacgucagccugaccgccaucgccaaccaggccacggugcucaugggccuggggaagggcuggccccuguccaagauggacaucggggugccgcuccuggcgaucggcugcuacagccaggucaaccccaucacccugaccgccgcccuccugcugcucguggcccacuacgcgaucaucgggcccggccugcaggccaaggccacccgggaggcccagaagcgcgccgcggccggcaucaugaagaaccccacgguggacgggaucaccgucaucgaccuggacccgauccccuacgaccccaaguucgagaagcagcucggccaggugaugcugcuggugcucugcgucacccaggugcugaugaugcggaccacgugggcccugugcgaggcccucacccuggccaccgggcccaucuccacccugugggagggcaacccggggcgcuucuggaacacgaccaucgcggugagcauggccaacaucuuccgcggcuccuaccucgccggcgccgggcugcuguucagcaucaugaagaacaccgccaacacccggcgcggcacggggaacaccggcgagacccucggcgagaaguggaagaaccggcugaacgcgcuggggaaguccgaguuccagaucuacaagaaguccggcauccaggaggucgaccgcacccucgccaaggaggggaucaagcggggcgagacggaccaccacgccgugucccgcgggagcgccaagcugcggugguucguggagcgcaaccuggucacccccgagggcaaggugguggaccucggcugcgggcggggcgggugguccuacuacugcggcgggcugaagaacgucaaggaggugaagggccugaccaagggcgggcccggccacgaggagcccaucccgaugagcaccuacggguggaaccucgugcgccugcaguccggcgucgacguguucuucacgccgcccgagaagugcgacacccugcucugcgacaucggggagagcucccccaacccgaccguggaggcgggccggacccugcgcguccugaaccucguggagaacuggcugaacaacaacacccaguucugcaucaaggugcugaaccccuacaugcccagcgucaucgagaagauggaggcccugcagcggaaguacggcggggcccucgugcgcaacccgcugagccggaacuccacgcacgagauguacugggugagcaacgccuccggcaacaucgucagcuccgugaacaugaucagccgcaugcugaucaaccgguucaccaugcgccacaagaaggccaccuacgagcccgacguggaccucggguccggcacccggaacaucgggaucgagagcgagacgcccaaccuggacaucaucggcaagcgcaucaagaagaucaagcaggagcacgagaccuccuggcacuacgaccaggaccaccccuacaagaccugggcguaccacggcagcuacgagaccaagcagacgggguccgccagcuccauggucaacggcguggugcgccugcucaccaagccgugggacgucauccccauggugacccagauggccaugaccgacacgacccccuucgggcagcagcgggucuucaaggagaagguggacacccgcacccaggagcccaaggagggcacgaagaagcugaugaagaucaccgccgaguggcuguggaaggagcucggcaagaagaagaccccgcggaugugcacccgcgaggaguucacgcggaaggugcgcagcaacgccgcgcugggggccaucuucaccgacgagaacaaguggaaguccgcccgggaggccgucgaggacagcggcuucugggagcugguggacaaggagcgcaaccuccaccuggaggggaagugcgagaccugcguguacaacaugaugggcaagcgggagaagaagcugggggaguucggcaaggccaagggcucccgcgcgaucugguacauguggcucggggcccgguuccuggaguucgaggcccugggcuuccucaacgaggaccacugguucagccgcgagaacucccugagcggggucgagggcgaggggcugcacaagcucggcuacauccugcgggacgugagcaagaaggagggcggggccauguacgcggacgacaccgccggcugggacacgcgcaucacccuggaggaccucaagaacgaggagauggugaccaaccacauggagggggagcacaagaagcuggccgaggccaucuucaagcugaccuaccagaacaaggucgugcgggugcagcgccccacgccccggggcaccgucauggacaucaucucccgccgggaccagcgcgggagcggccagguggugaccuacggccucaacaccuucacgaacauggaggcccagcugauccggcagauggagggggagggcgucuucaaguccauccagcagcugaccgugaaggaggagaucgcggugaagaacuggcucauccgcgucgggcgcgagcggcugagccgcauggccaucuccggcgacgacugcguggugaagccccuggacgaccgguucgccagcgcccucaccgcccugaacgacaugggcaagguccgcaaggacauccagcagugggagccgucccggggguggaacgacuggacccaggugcccuucugcagccaccacuuccacgagcugaucaugaaggacggccgcgugcucgucgugcccugccggaaccaggacgagcugaucgggcgcgcgcggaucucccagggcgccggguggagccugcgcgagacggccugccucggcaaguccuacgcccagauguggagccugauguacuuccaccggcgcgaccugcggcucgccgcgaacgccaucugcuccgccgugcccagccacugggucccgaccucccgcaccaccuggagcauccacgccacccacgaguggaugacgaccgaggacaugcugaccguguggaaccggguguggauccaggagaaccccuggauggaggacaagacccccgucgaguccugggaggagauccccuaccugggcaagcgcgaggaccaguggugcgggagccucaucggccugacgagccgggccaccugggcgaagaacauccagaccgccaucaaccaggugcgcucccugaucgggaacgaggaguacaccgacuacaugccgagcaugaagcgguuccgccgcgaggaggaggaggccggcgugcucugguga

SEQ ID NO: 9702 - RNA, 9876 nt, Artificial Sequence
  derived and/or modified CDS sequence (opt1) from DENV-2__KM279605__SS-prME
accgccggcaucaucaucaugaugauccccaccgugauggccuuccaccugaccacccggaacggggagccccacaugaucgucucccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacaaccccgugaacaucgaggccgagccgcccuucggggacuccuacaucaucaucggcguggagccggggcagcugaagcugagcugguucaagaagggcuccagcaucgggcagauguucgagaccaccaugcgcggcgccaagcggauggccauccucggcgacacggccugggacuucgggucccugggcggggucuucaccagcaucggcaaggcgcugcaccagguguucggggccaucuacggcgccgccuucuccggcgugagcuggaccaugaagauccucaucggggucgugaucaccuggaucggcaugaacucccgcagcacgucccugagcgugucccugguccugguggggguggucacccucuaccugggcgugauggugcaggcggacagcgggugcgucguguccuggaagaacaaggagcugaagugcggcagcggcaucuucaucaccgacaacgugcacaccuggacggagcaguacaaguuccagcccgagagccccuccaagcucgccagcgccauccagaaggcccacgaggaggggaucugcggcauccgguccgucacccgccuggagaaccugauguggaagcagaucacccccgagcucaaccacauccugaccgagaacgaggugaagcugacgaucaugaccggggacaucaagggcaucaugcaggccgggaagcggagccuccgcccgcagcccaccgagcugaaguacuccuggaaggcguggggcaaggccaagaugcugagcaccgagcuccacaaccacacguuccugaucgacggccccgagaccgccgagugcccgaacaccaaccgggccuggaacucccuggagguggaggacuacggguucggcgucuucaccacgaacaucuggcucaagcugaaggagcgccaggacguguucugcgacagcaagcugauguccgccgcgaucaaggacaaccgggccgugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcacgaccgucguggugaccgaggacugcgggaaccgcggccccucccugcggaccacgaccgccagcggcaagcucaucaccgaguggugcugccgcagcugcacccugcccccgcugcgguaccgcggggaggacggcugcugguacgggauggagauccggccccucaaggagaaggaggagaaccuggucaacucccuggugacggccggccacgggcagaucgacaacuucagccucggcgugcugggcauggcgcuguuccucgaggagaugcugcgcacccgggucgggaccaagcacgccauccugcucguggccguguccuucgucacccugaucacgggcaacaugagcuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccuccaaggagcugaugaugaccaccaucgggaucguccugcucagccaguccacgauccccgagagcauccuggagcugaccgacgcccucgcgcugggcaugauggugcugaagaucguccggaacauggagaaguaccagcucgccgugaccaucauggccauccugugcgugccgaacgccgucauccuggagaacgccuggaagguguccugcaccacgcucgcgguggucagcgugagcccccugcugcucaccagcucccagcagaaggccgacuggaucccccuggcccugaccaucaaggggcucaaccccaccgccaucuuccugacgacccugagccgcaccuccaagaagcggagcuggccgcucaacgaggcgaucauggccgugggcauggucuccauccuggccagcucccugcucaagaacgacauccccaugaccggcccccugguggccgggggccugcucacggugugcuacguccugaccgggcgcagcgccgaccuggagcucgagcgggcggccgacgugcgcugggaggagcaggccgagaucagcggcuccagccccauccuguccaucaccaucagcgaggacggguccaugagcaucaagaacgaggaggaggagcagacccugacgauccucauccggaccggccugcuggugaucuccggccucuucccggucagcauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacagccagaucggcgccggcguguacaaggaggggaccuuccacaccauguggcacgucacgcgcggcgcggugcugaugcacaaggggaagcggaucgagcccuccugggccgacgugaagaaggaccucaucagcuacggcgggggcuggaagcuggagggcgaguggaaggagggggaggagguccaggugcuggcccucgagcccggcaagaacccccgcgccgugcagaccaagcccgggcuguucaagaccaacaccggcacgaucggggccgucucccuggacuucagccccggcaccuccggcagccccaucguggacaagaaggggaagguggucggccucuacgggaacggcguggugacccgguccggcaccuacgucagcgcgaucgcccagacggagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcguggucgccgccgagauggaggaggcccuccgcggccugcccauccgguaccagacccccgcgauccgcgccgagcacaccgggcgggagaucguggaccugaugugccacgccaccuucacgaugcgccuccugagccccauccgggugccgaacuacaaccugaucaucauggacgaggcccacuucaccgaccccgccagcaucgcggcccgcggcuacaucuccacccgggucgagaugggcgaggccgccgggaucuucaugaccgccacgccgcccggcagccgcgacccguucccccaguccaacgcgcccaucauggacgaggagcgggagauccccgagcgcagcuggaacuccgggcacgagugggugaccgacuucaagggcaagaccgugugguucgucccgagcaucaaggccgggaacgacaucgccgccugccuccggaagaacggcaagaaggugauccagcugucccgcaagaccuucgacagcgaguacaucaagacgcggaccaacgacugggacuucguggucaccaccgacaucuccgagaugggcgcgaacuucaaggccgagcgcgugaucgacccccggcgcugcaugaagcccgugauccugacggacggggaggagcgggucauccucgccggccccaugccggugacccacagcuccgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccgagcauguucgagcccgagcgggagaaggucgacgccaucgacggcgaguaccgccugcgcggggaggcccgcaagaccuucguggaccugaugcggcgcggcgaccuccccgucuggcuggccuacaagguggcggccgaggggaucaacuacgccgaccggcgcuggugcuucgacggcgugaagaacaaccagauccuggaggagaacgucgagguggagaucuggacgaaggagggggagcggaagaagcucaagccgcgcuggcuggacgcccggaucuacuccgacccccuggcccucaaggaguucaaggaguucgcggccggccgcaagagccugacccugaaccucaucaccgagaugggccggcugcccaccuucaugacgcagaaggccaagaacgcccuggacaaccucgcggugcugcacaccgccgaggccgggggccgcgccuacaaccacgcccuguccgagcuccccgagacccuggagacccugcuccugcugacgcuccuggcgaccgucaccgggggcaucuuccuguuccucaugagcggcaaggggaucggcaagaugacccuggggaugugcugcaucaucaccgccuccauccugcucugguacgcccagauccagccgcacuggaucgccgccagcaucauccuggaguucuuccugaucgugcuccugauccccgagcccgagaagcagcggacgccccaggacaaccagcugaccuacguggucaucgcgauccucaccgugguggccgccaccauggccaacgagaugggcuuccuggagaagacgaagaaggacuucgggcugggcuccaucaccacccagcagccggagagcaacauccucgacaucgaccugcgccccgccagcgcguggacccuguacgccgucgccacgaccuucaucacccccaugcuccggcacuccaucgagaacagcuccgugaacgugagccugaccgccaucgccaaccaggcgacgguccugaugggccucgggaagggcuggccccuguccaagauggacaucggggugccgcugcucgccaucggcugcuacagccaggugaaccccaucacccugaccgccgcccugcuccugcuggucgcgcacuacgccaucaucgggcccggccuccaggccaaggccacccgcgaggcccagaagcgggcggccgccggcaucaugaagaaccccacgguggacgggaucaccgugaucgaccuggacccgauccccuacgaccccaaguucgagaagcagcugggccaggucaugcuccuggugcugugcgugacccagguccucaugaugcgcaccacgugggcccugugcgaggcccugacccucgcgaccgggcccaucuccacccugugggagggcaacccggggcgguucuggaacacgaccaucgccgugagcauggccaacaucuuccgcggcuccuaccuggccggcgccgggcuccuguucagcaucaugaagaacaccgcgaacacccgccggggcacggggaacaccggcgagacccugggcgagaaguggaagaaccgccucaacgcccuggggaaguccgaguuccagaucuacaagaaguccggcauccaggagguggaccggacccuggccaaggaggggaucaagcgcggcgagacggaccaccacgccgucucccgggggagcgcgaagcuccgcugguucguggagcggaaccuggugacccccgagggcaaggucguggaccugggcugcgggcgcggcgggugguccuacuacugcggcgggcucaagaacgugaaggaggucaagggccugaccaagggcgggcccggccacgaggagcccaucccgaugagcaccuacggguggaaccuggugcggcuccaguccggcguggacgucuucuucacgccgcccgagaagugcgacacccugcugugcgacaucggggagagcucccccaacccgaccguggaggccggccgcacccuccgggugcugaaccuggucgagaacuggcucaacaacaacacccaguucugcaucaaggugcugaaccccuacaugcccagcgugaucgagaagauggaggcccugcagcgcaaguacggcggggcccugguccggaacccgcucagccgcaacuccacgcacgagauguacugggugagcaacgccuccggcaacaucgugagcuccgucaacaugaucagccggaugcugaucaaccgcuucaccaugcggcacaagaaggcgaccuacgagcccgacguggaccugggguccggcacccgcaacaucgggaucgagagcgagacgcccaaccucgacaucaucggcaagcggaucgagaagaucaagcaggagcacgagaccuccuggcacuacgaccaggaccaccccuacaagaccugggccuaccacggcagcuacgagaccaagcagacgggguccgccagcuccauggugaacggcgucgugcgccugcugaccaagccgugggacgugauccccauggucacccagauggccaugaccgacacgacccccuucgggcagcagcgcguguucaaggagaaggucgacacccggacccaggagcccaaggagggcacgaagaagcucaugaagaucaccgccgaguggcuguggaaggagcugggcaagaagaagaccccgcgcaugugcacccgggaggaguucacgcgcaaggugcggagcaacgcggcccucggggccaucuucaccgacgagaacaaguggaaguccgcccgcgaggccguggaggacagcggcuucugggagcuggucgacaaggagcggaaccugcaccucgaggggaagugcgagaccugcguguacaacaugaugggcaagcgcgagaagaagcugggggaguucggcaaggcgaagggcucccgggccaucugguacauguggcugggggcccgcuuccucgaguucgaggcccugggcuuccugaacgaggaccacugguucagccgggagaacucccucagcgggguggagggcgaggggcugcacaagcugggcuacauccuccgcgacgucagcaagaaggagggcggggcgauguacgccgacgacaccgccggcugggacacgcggaucacccuggaggaccugaagaacgaggagauggugaccaaccacauggagggggagcacaagaagcucgccgaggccaucuucaagcugaccuaccagaacaaggugguccgcgugcagcggcccacgccccgcggcaccgugauggacaucaucucccggcgcgaccagcgggggagcggccaggucgugaccuacggccugaacaccuucacgaacauggaggcgcagcucauccgccagauggagggggagggcguguucaaguccauccagcagcugaccgucaaggaggagaucgccgugaagaacuggcugauccggguggggcgcgagcgccucagccggauggccaucuccggcgacgacugcgucgugaagccccuggacgaccgcuucgccagcgcccugaccgcgcucaacgacaugggcaaggugcggaaggacauccagcagugggagccgucccgcggguggaacgacuggacccagguccccuucugcagccaccacuuccacgagcugaucaugaaggacggccgggugcuggugguccccugccgcaaccaggacgagcucaucgggcgggcccgcaucucccagggcgccggguggagccugcgggagacggccugccugggcaaguccuacgcccagauguggagccucauguacuuccaccgccgggaccugcgccuggcggccaacgccaucugcuccgccgugcccagccacugggugccgaccucccggaccaccuggagcauccacgccacccacgaguggaugacgaccgaggacaugcucaccgucuggaaccgcguguggauccaggagaaccccuggauggaggacaagacccccguggaguccugggaggagauccccuaccugggcaagcgggaggaccaguggugcgggagccugaucggccucacgagccgcgcgaccugggccaagaacauccagaccgccaucaaccagguccggucccugaucgggaacgaggaguacaccgacuacaugccgagcaugaagcgcuuccggcgcgaggaggaggaggccggcgugcugugguga

SEQ ID NO: 9703 - RNA, 9876 nt, Artificial Sequence
  derived and/or modified CDS sequence (opt1) from DENV-2__KM279609__SS-prME
accgcggggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccuggccacccuccgcaaguacugcguggaggccaagcugaccaacacgaccaccgcgagccggugccccacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucacgccccagagcuccaucaccgaggccgagcugaccggcuacgggaccgugacgauggagugcagcccgcgcaccggccucgacuucaacgagauggugcugcugcagauggagaacaaggccuggcucguccaccggcagugguuccuggaccugccccuccccuggcugcccggcgcggacacccagggguccaacuggauccagaaggagacccuggugacguucaagaacccgcacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaaccccaucgucaccgagaaggacuccccggugaacaucgaggccgagccgcccuucggggacagcuacaucaucaucggcguggagcccgggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagccggagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccccagccgaccgagcugaaguacagcuggaaggcguggggcaaggccaagaugcucuccaccgagcugcacaaccacacguuccugaucgacggccccgagaccgccgagugccccaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgccccggguaccacacccagaccgccggcccguggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugccgccccuccgguaccgcggggaggacggcugcugguacgggauggagauccggccgcugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccgaguccauccuggagcucaccgacgcccuggcgcugggcaugauggugcucaagaucguccggaacauggagaaguaccagcuggccgugaccaucauggccauccugugcgugcccaacgccgucauccuccagaacgccuggaaggugagcugcaccacgcuggcgguggucuccgugagcccgcugcuccugaccuccagccagcagaaggccgacuggaucccccuggcccucaccaucaaggggcugaaccccaccgccaucuuccugacgacccucucccgcaccagcaagaagcgguccuggccccugaacgaggcgaucauggccgugggcauggucagcauccuggccuccagccuccugaagaacgacaucccgaugaccggcccccugguggccgggggccuccugacggugugcuacguccugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguuccccgucuccaucccgaucaccgccgccgcgugguaccugugggaggugaagaagcagcgcgccggggugcucugggacguccccuccccgccgcccgugggcaaggccgagcuggaggacggggccuaccggaucaagcagaagggcauccugggguacucccagaucggcgccggcguguacaaggaggggaccuuccacaccauguggcacgucacgcgcggcgcggugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccgcgcgccgugcagaccaagcccgggcuguucaagaccaacaccggcacgaucggggccgucagccucgacuucucccccggcaccagcggcucccccaucguggacaagaaggggaagguggucggccuguacgggaacggcguggugacccggagcggcaccuacgucuccgcgaucgcccagacggagaaguccaucgaggacaacccggagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgcccccacgcgcguggucgccgccgagauggaggaggcccugcgcggccugccgauccgguaccagacccccgcgauccgcgccgagcacaccgggcgggagaucguggaccucaugugccacgccaccuucacgaugcgccugcugagccccauccgggugcccaacuacaaccucaucaucauggacgaggcccacuucaccgacccggccuccaucgcggcccgcggcuacaucagcacccgggucgagaugggcgaggccgccgggaucuucaugaccgccacgccgcccggcucccgcgaccccuucccgcagagcaacgcgcccaucauggacgaggagcgggagauccccgagcgcuccuggaacagcgggcacgagugggugaccgacuucaagggcaagaccgugugguucguccccuccaucaaggccgggaacgacaucgccgccugccugcggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccgcggcgcugcaugaagcccgugauccucacggacggggaggagcgggucauccuggccggccccaugcccgugacccacuccagcgccgcccagcgccgggggcgcgugggccgcaacccgaagaacgagaacgaccaguacaucuacaugggggagccccuggagaacgacgaggacugcgcgcacuggaaggaggccaagaugcuccuggacaacaucaacacccccgagggcaucauccccuccauguucgagccggagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcgugaagaacaaccagauccucgaggagaacgucgagguggagaucuggacgaaggagggggagcgcaagaagcugaagccccgguggcuggacgcccgcaucuacagcgacccgcucgcccugaaggaguucaaggaguucgcggccggccggaagucccugacccucaaccugaucaccgagaugggccgccugcccaccuucaugacgcagaaggccaagaacgcccucgacaaccuggcggugcugcacaccgccgaggccgggggccgggccuacaaccacgcccucagcgagcugcccgagacccuggagacccuccugcugcucacgcugcuggcgaccgucaccgggggcaucuuccucuuccugauguccggcaaggggaucggcaagaugacccuggggaugugcugcaucaucaccgccagcauccuccugugguacgcccagauccagccccacuggaucgccgccuccaucauccuggaguucuuccucaucgugcugcugaucccggagcccgagaagcagcgcacgccccaggacaaccagcucaccuacguggucaucgcgauccugaccgugguggccgccaccauggccaacgagaugggcuuccuggagaagacgaagaaggacuucgggcucggcagcaucaccacccagcagcccgagagcaacauccuggacaucgaccugcggccggccuccgcguggacccucuacgccgucgccacgaccuucaucacccccaugcugcgccacagcaucgagaacuccagcgugaacgugucccugaccgccaucgccaaccaggcgacgguccucaugggccuggggaagggcuggccccugagcaagauggacaucggggugccccuccuggccaucggcugcuacucccaggugaacccgaucacccugaccgccgcccuccugcugcucgucgcgcacuacgccaucaucgggcccggccugcaggccaaggccacccgggaggcccagaagcgcgcggccgccggcaucaugaagaaccccacgguggacgggaugaccgugaucgaccuggaccccaucccguacgaccccaaguucgagaagcagcucggccaggucaugcugcuggugcucugcgugacccagguccugaugaugcggaccacgugggcccugugcgaggcccucacccuggcgaccgggcccaucagcacccugugggagggcaaccccgggcgcuucuggaacacgaccaucgccguguccauggccaacaucuuccgcggcagcuaccucgccggcgccgggcugcuguucuccaucaugaagaacaccgcgaacacccggcgcggcacggggaacaccggcgagacccucggcgagaaguggaagaaccggcugaacgcccugggcaagagcgaguuccagaucuacaagaaguccggcauccaggagguggaccgcacccucgccaaggaggggaucaagcggggcgagacggaccaccacgccgucagccgcggguccgcgaagcugcggugguucguggagcgcaaccuggugaccccggagggcaaggucguggaccucggcugcgggcggggcggguggagcuacuacugcggcgggcugaagaacgugaaggaggucaagggccugaccaagggcgggcccggccacgaggagcccauccccauguccaccuacggguggaaccucgugcgccugcagagcggcguggacgucuucuucacgccgcccgagaagugcgacacccugcucugcgacaucggggaguccagccccaaccccaccguggaggccggccggacccugcgcgugcugaaccucgucgagaacuggcugaacaacaacacccaguucugcaucaaggugcugaacccguacaugcccagcgugaucgagaagauggaggcccugcagcggaaguacggcggggcccucguccgcaacccccugucccggaacagcacgcacgagauguacuggguguccaacgccagcggcaacaucguguccagcgucaacaugaucucccgcaugcugaucaaccgguucaccaugcgccacaagaaggcgaccuacgagccggacguggaccucgggagcggcacccggaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcucaccaagcccugggacgugaucccgauggucacccagauggccaugaccgacacgacccccuucgggcagcagcggguguucaaggagaaggucgacacccgcacccaggagcccaaggagggcacgaagaagcugaugaagaucaccgccgaguggcuguggaaggagcucggcaagaagaagacgccccggaugugcacccgcgaggaguucacgcggaaggugcgcuccaacgcggcccugggggccaucuucaccgacgagaacaaguggaaguccgcccgggaggccguggaggacuccggcuucugggagcuggucgacaaggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccugagcgggguggagggcgaggggcugcacaagcucggcuacauccugcgggacgucuccaagaaggagggcggggcgauguacgccgacgacaccgccggcugggacacgcgcaucacccuggaggaccucaagaacgaggagauggugaccaaccacauggagggggagcacaagaagcuggccgaggccaucuucaagcugaccuaccagaacaaggugguccgggugcagcgcccgacgccccggggcaccgugauggacaucaucagccgccgggaccagcgcggguccggccaggucgugaccuacggccucaacaccuucacgaacauggaggcgcagcugauccggcagauggagggggagggcguguucaagagcauccagcagcugaccgucaaggaggagaucgccgugaagaacuggcucauccgcguggggcgcgagcggcugucccgcauggccaucagcggcgacgacugcgucgugaagccccuggacgaccgguucgccuccgcccucaccgcgcugaacgacaugggcaaggugcgcaaggacauccagcagugggagcccagccggggguggaacgacuggacccaggucccguucugcucccaccacuuccacgagcugaucaugaaggacggccgcgugcucgugguccccugccggaaccaggacgagcugaucgggcgcgcccggaucagccagggcgccggguggucccugcgcgagacggccugccucggcaagagcuacgcccagauguggucccugauguacuuccaccggcgcgaccugcggcucgcggccaacgccaucugcagcgccgugcccucccacuggauccccaccagccgcaccaccugguccauccacgccacccacgaguggaugacgaccgaggacaugcugaccguguggaaccgggucuggauccaggagaacccguggauggaggacaagacccccguggagagcugggaggagauccccuaccugggcaagcgcgaggaccaguggugcgggagccucaucggccugacgucccgggcgaccugggccaagaacauccagaccgccaucaaccaggugcgcagccugaucgggaacgaggaguacaccgacuacaugcccuccaugaagcgguuccgccgcgaggaggaggaggccggcguccucugguga

SEQ ID NO: 9704 - RNA, 9876 nt, Artificial Sequence
  derived and/or modified CDS sequence (opt1) from DENV-2__KM279607__SS-prME
accgcgggcaucaucaucaugaugauccccaccgugauggccuuccaccugaccacccggaacggggagccccacaugaucgucucccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggauccuccgccaccccggguucacgaucauggcggccauccuggccuacaccaucggcaccaccuaccugcagcggguccucaucuucauccugcugacggccgugacccccuccauggcgaugcgcugcaucgggaucagcaaccgggacuucguggagggcgucuccggcgggagcuggguggacaucgugcucgagcacggcuccugcgucaccaccauggccaagaacaagcccacgcuggacuucgagcugaucaagaccgaggccaagcaccccgccacccuccgcaaguacugcguggaggccaagcugaccaacacgaccaccgcgagccggugcccgacccagggggagcccucccugaacgaggagcaggacaagcgcuucgugugcaagcacagcauggucgaccggggcuggggcaacgggugcggccucuucgggaagggcgggaucgugacgugcgccauguucacgugcaagaagaacauggagggcaaggugguccagcccgagaaccuggaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccucgacuucaacgagauggugcugcugcagauggagaacaaggccuggcucguccaccggcagugguuccuggaccugccccuccccuggcugccgggcgcggacacccagggguccaacuggauccagaaggagacccuggugacguucaagaacccccacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaacccgaucgucaccgagaaggacaaccccgugaacaucgaggccgagccgcccuucggggacuccuacaucaucaucggcguggagccggggcagcugaagcucagcugguacaagaagggcuccagcaucgggcagauguucgagaccaccaugcgcggcgccaagcggauggccauccugggcgacacggccugggacuucgggucccugggcggggucuucaccagcaucggcaaggcgcuccaccagguguucggggccaucuacggcgccgccuucuccggcgugagcuggaccaugaagauccugaucggggucgugaucaccuggaucggcaugaacucccgcagcacgucccugagcgugucccugguccucguggggguggucacccuguaccugggcgugauggugcaggcggacagcgggugcgucguguccuggaagaacaaggagcucaagugcggcagcggcaucuucaucaccgacaacgugcacaccuggacggagcaguacaaguuccagcccgagagccccuccaagcuggccagcgccauccagaaggcccacgaggaggggaucugcggcauccgguccgucacccgccuggagaaccucauguggaagcagaucacccccgagcugaaccacauccugaccgagaacgaggugaagcucacgaucaugaccggggacaucaagggcaucaugcaggccgggaagcggagccugcgcccgcagcccaccgagcugaaguacuccuggaaggcguggggcaaggccaagaugcucagcaccgagcugcacaaccacacguuccugaucgacggccccgagaccgccgagugcccgaacaccaaccgggccuggaacucccucgagguggaggacuacggguucggcgucuucaccacgaacaucuggcugaagcugaaggagcgccaggacguguucugcgacagcaagcucauguccgccgcgaucaaggacaaccgggccgugcacgccgacaugggguacuggaucgagagcgcccugaacgacaccuggaagaucgagaaggccuccuucaucgaggucaagagcugccacuggcccaagucccacacccuguggagcaacggcgugcucgaguccgagaugaucauccccaagaacuucgcgggccccgugagccagcacaacuaccgcccgggguaccacacccagaccgccggccccuggcaccuggggcggcuggagauggacuucgacuucugcgagggcacgaccgucguggugaccgaggacugcgggaaccgcggccccucccuccggaccacgaccgccagcggcaagcugaucaccgaguggugcugccgcagcugcacccugcccccgcuccgguaccgcggggaggacggcugcugguacgggauggagauccggccccugaaggagaaggaggagaaccuggucaacucccucgugacggccggccacgggcagaucgacaacuucagccugggcgugcugggcauggcccucuuccuggaggagaugcugcgcacccgggucgggaccaagcacgccauccuccugguggccguguccuucgucacccugaucacgggcaacaugagcuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccuccaaggagcugaugaugaccaccaucgggaucguccuccugagccaguccacgauccccgagagcauccuggagcucaccgacgcccuggcgcugggcaugauggugcucaagaucguccggaacauggagaaguaccagcuggccgugaccaucauggccauccugugcgugccgaacgccgucauccucgagaacgccuggaagguguccugcaccacgcuggcgguggucagcgugagcccccugcuccugaccagcucccagcagaaggccgacuggaucccccuggcccucaccaucaaggggcugaaccccaccgccaucuuccugacgacccucagccgcaccuccaagaagcggagcuggccgcugaacgaggcgaucauggccgugggcauggucuccauccuggccagcucccuccugaagaacgacauccccaugaccggcccccugguggccgggggccuccugacggugugcuacguccugaccgggcgcagcgccgaccucgagcuggagcgggcggccgacgugcgcugggaggagcaggccgagaucagcggcuccagccccauccuguccaucaccaucagcgaggacggguccaugagcaucaagaacgaggaggaggagcagacccucacgauccugauccggaccggccugcucgugaucuccggccuguucccggucagcauccccaucaccgccgccgcgugguaccugugggaggugaagaagcagcgcgccggggugcucugggacguccccagcccgccgcccgugggcaaggccgagcuggaggacggggccuaccggaucaagcagaagggcauccugggguacagccagaucggcgccggcguguacaaggaggggaccuuccacaccauguggcacgucacgcgcggcgcggugcucaugcacaaggggaagcggaucgagcccuccugggccgacgugaagaaggaccugaucagcuacggcgggggcuggaagcuggagggcgaguggaaggagggggaggagguccaggugcucgcccuggagcccggcaagaacccccgcgccgugcagaccaagcccgggcuguucaagaccaacaccggcacgaucggggccgucucccucgacuucagccccggcaccuccggcagccccaucguggacaagaaggggaagguggucggccuguacgggaacggcguggugacccgguccggcaccuacgucagcgcgaucgcccagacggagaaguccaucgaggacaaccccgagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgccccgacgcgcguggucgccgccgagauggaggaggcccugcgcggccugcccauccgguaccagacccccgcgauccgcgccgagcacaccgggcgggagaucguggaccucaugugccacgccaccuucacgaugcgccugcugagccccauccgggugccgaacuacaaccucaucaucauggacgaggcccacuucaccgaccccgccagcaucgcggcccgcggcuacaucuccacccgggucgagaugggcgaggccgccgggaucuucaugaccgccacgccgcccggcagccgcgacccguucccccaguccaacgcgcccaucauggacgaggagcgggagauccccgagcgcagcuggaacuccgggcacgagugggugaccgacuucaagggcaagaccgugugguucgucccgagcaucaaggccgggaacgacaucgccgccugccugcggaagaacggcaagaaggugauccagcugucccgcaagaccuucgacagcgaguacaucaagacgcggaccaacgacugggacuucguggucaccaccgacaucuccgagaugggcgcgaacuucaaggccgagcgcgugaucgacccccggcgcugcaugaagcccgugauccucacggacggggaggagcgggucauccuggccggccccaugccggugacccacagcuccgccgcccagcgccgggggcgcgugggccgcaaccccaagaacgagaacgaccaguacaucuacaugggggagccccuggagaacgacgaggacugcgcgcacuggaaggaggccaagaugcuccuggacaacaucaacacccccgagggcaucaucccgagcauguucgagcccgagcgggagaaggucgacgccaucgacggcgaguaccgccugcgcggggaggcccgcaagaccuucguggaccucaugcggcgcggcgaccugcccgucuggcuggccuacaagguggcggccgaggggaucaacuacgccgaccggcgcuggugcuucgacggcgugaagaacaaccagauccucgaggagaacgucgagguggagaucuggacgaaggagggggagcggaagaagcugaagccgcgcuggcuggacgcccggaucuacuccgacccccucgcccugaaggaguucaaggaguucgcggccggccgcaagagccugacccucaaccugaucaccgagaugggccggcugcccaccuucaugacgcagaaggccaagaacgcccucgacaaccuggcggugcugcacaccgccgaggccgggggccgcgccuacaaccacgcccucuccgagcugcccgagacccuggagacccuccugcugcucacgcugcuggcgaccgucaccgggggcaucuuccucuuccugaugagcggcaaggggaucggcaagaugacccuggggaugugcugcaucaucaccgccuccauccuccugugguacgcccagauccagccgcacuggaucgccgccagcaucauccuggaguucuuccucaucgugcugcugauccccgagcccgagaagcagcggacgccccaggacaaccagcucaccuacguggucaucgcgauccugaccgugguggccgccaccauggccaacgagaugggcuuccuggagaagacgaagaaggacuucgggcucggcuccaucaccacccagcagccggagagcaacauccuggacaucgaccugcgccccgccagcgcguggacccucuacgccgucgccacgaccuucaucacccccaugcugcggcacuccaucgagaacagcuccgugaacgugagccugaccgccaucgccaaccaggcgacgguccucaugggccuggggaagggcuggccccuguccaagauggacaucggggugccgcuccuggccaucggcugcuacagccaggugaaccccaucacccugaccgccgcccuccugcugcucgucgcgcacuacgccaucaucgggcccggccugcaggccaaggccacccgcgaggcccagaagcgggcggccgccggcaucaugaagaaccccacgguggacgggaucaccgugaucgaccuggacccgauccccuacgaccccaaguucgagaagcagcucggccaggucaugcugcuggugcucugcgugacccagguccugaugaugcgcaccacgugggcccugugcgaggcccucacccuggcgaccgggcccaucuccacccugugggagggcaacccggggcgguucuggaacacgaccaucgccgugagcauggccaacaucuuccgcggcuccuaccucgccggcgccgggcugcuguucagcaucaugaagaacaccgcgaacacccgccggggcacggggaacaccggcgagacccucggcgagaaguggaagaaccgccugaacgcccuggggaaguccgaguuccagaucuacaagaaguccggcauccaggagguggaccggacccucgccaaggaggggaucaagcgcggcgagacggaccaccacgccgucucccgggggagcgcgaagcugcgcugguucguggagcggaaccuggugacccccgagggcaaggucguggaccucggcugcgggcgcggcgggugguccuacuacugcggcgggcugaagaacgugaaggaggucaagggccugaccaagggcgggcccggccacgaggagcccaucccgaugagcaccuacggguggaaccucgugcggcugcaguccggcguggacgucuucuucacgccgcccgagaagugcgacacccugcucugcgacaucggggagagcucccccaacccgaccguggaggccggccgcacccugcgggugcugaaccucgucgagaacuggcugaacaacaacacccaguucugcaucaaggugcugaaccccuacaugcccagcgugaucgagaagauggaggcccugcagcgcaaguacggcggggcccucguccggaacccgcugagccgcaacuccacgcacgagauguacugggugagcaacgccuccggcaacaucgugagcuccgucaacaugaucagccggaugcugaucaaccgcuucaccaugcggcacaagaaggcgaccuacgagcccgacguggaccucggguccggcacccgcaacaucgggaucgagagcgagacgcccaaccuggacaucaucggcaagcggaucgagaagaucaagcaggagcacgagaccuccuggcacuacgaccaggaccaccccuacaagaccugggccuaccacggcagcuacgagaccaagcagacgggguccgccagcuccauggugaacggcgucgugaagcugcucaccaagccgugggacgugauccccauggucacccagauggccaugaccgacacgacccccuucgggcagcagcgcguguucaaggagaaggucgacacccgcacccaggagcccaaggagggcacgaagaagcugaugaagaucaccgccgaguggcuguggaaggagcucggcaagaagaagaccccgcggaugugcacccgcgaggaguucacgcggaaggugcgcagcaacgcggcccugggggccaucuucaccgacgagaacaaguggaaguccgcccgggaggccguggaggacagcggcuucugggagcuggucgacaaggagcgcaaccuccaccuggaggggaagugcgagaccugcguguacaacaugaugggcaagcgggagaagaagcugggggaguucggcaaggcgaagggcucccgcgccaucugguacauguggcucggggcccgguuccuggaguucgaggcccugggcuuccucaacgaggaccacugguucagccgcgagaacucccugagcgggguggagggcgaggggcugcacaagcucggcuacauccugcgggacgucagcaagaaggagggcggggcgauguacgccgacgacaccgccggcugggacacgcgcaucacccuggaggaccucaagaacgaggagauggugaccaaccacauggagggggagcacaagaagcuggccgaggccaucuucaagcugaccuaccagaacaaggugguccgggugcagcgccccacgccccggggcaccgugauggacaucaucucccgccgggaccagcgcgggagcggccaggucgugaccuacggccucaacaccuucacgaacauggaggcgcagcugauccggcagauggagggggagggcguguucaaguccauccagcagcugaccgucaaggaggagaucgccgugaagaacuggcucauccgcguggggcgggagcgccugagccgcauggccaucuccggcgacgacugcgucgugaagccccuggacgaccgguucgccagcgcccucaccgcgcugaacgacaugggcaaggugcgcaaggacauccagcagugggagccgucccggggguggaacgacuggacccagguccccuucugcagccaccacuuccacgagcugaucaugaaggacggccgcgugcucgugguccccugccggaaccaggacgagcugaucgggcgcgcccggaucucccagggcgccggguggagccugcgcgagacggccugccucggcaaguccuacgcccagauguggagccugauguacuuccaccggcgcgaccugcggcucgcggccaacgccaucugcuccgccgugcccagccacugggugccgaccucccgcaccaccuggagcauccacgccacccacgaguggaugacgaccgaggacaugcugaccgucuggaaccggguguggauccaggagaaccccuggauggaggacaagacccccguggaguccugggaggagauccccuaccugggcaagcgcgaggaccaguggugcgggagccucaucggccugacgagccgggcgaccugggccaagaacauccagaccgccaucaaccagguccgcucccugaucgggaacgaggaguacaccgacuacaugccgagcaugaagcgguuccgccgggaggaggaggaggccggcgugcucugguga

SEQ ID NO: 9705 - RNA, 9876 nt, Artificial Sequence
  derived and/or modified CDS sequence (opt1) from DENV-2__KM279606__SS-prME
accgccggcaucaucaucaugaugauccccaccgugauggccuuccaccugaccacccggaacggggagccccacaugaucgucucccggcaggagaagggcaagucccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacaaccccgugaacaucgaggccgagccgcccuucggggacuccuacaucaucaucggcguggagccggggcagcugaagcugagcugguacaagaagggcuccagcaucgggcagauguucgagaccaccaugcgcggcgccaagcggauggccauccucggcgacacggccugggacuucgggucccugggcggggucuucaccagcaucggcaaggcgcugcaccagguguucggggccaucuacggcgccgccuucuccggcgugagcuggaccaugaagauccucaucggggucgugaucaccuggaucggcaugaacucccgcagcacgucccugagcgugucccugguccugguggggguggucacccucuaccugggcgugauggugcaggcggacagcgggugcgucguguccuggaagaacaaggagcugaagugcggcagcggcaucuucaucaccgacaacgugcacaccuggacggagcaguacaaguuccagcccgagagccccuccaagcucgccagcgccauccagaaggcccacgaggaggggaucugcggcauccgguccgucacccgccuggagaaccugauguggaagcagaucacccccgagcucaaccacauccugaccgagaacgaggugaagcugacgaucaugaccggggacaucaagggcaucaugcaggccgggaagcggagccuccgcccgcagcccaccgagcugaaguacuccuggaaggcguggggcaaggccaagaugcugagcaccgagcuccacaaccacacguuccugaucgacggccccgagaccgccgagugcccgaacaccaaccgggccuggaacucccuggagguggaggacuacggguucggcgucuucaccacgaacaucuggcucaagcugaaggagcgccaggacguguucugcgacagcaagcugauguccgccgcgaucaaggacaaccgggccgugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcacgaccgucguggugaccgaggacugcgggaaccgcggccccucccugcggaccacgaccgccagcggcaagcucaucaccgaguggugcugccgcagcugcacccugcccccgcugcgguaccgcggggaggacggcugcugguacgggauggagauccggccccucaaggagaaggaggagaaccuggucaacucccuggugacggccggccacgggcagaucgacaacuucagccucggcgugcugggcauggcgcuguuccucgaggagaugcugcgcacccgggucgggaccaagcacgccauccugcucguggccguguccuucgucacccugaucacgggcaacaugagcuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccuccaaggagcugaugaugaccaccaucgggaucguccugcucagccaguccacgauccccgagagcauccuggagcugaccgacgcccucgcgcugggcaugauggugcugaagaucguccggaacauggagaaguaccagcucgccgugaccaucauggccauccugugcgugccgaacgccgucauccuggagaacgccuggaagguguccugcaccacgcucgcgguggucagcgugagcccccugcugcucaccagcucccagcagaaggccgacuggaucccccuggcccugaccaucaaggggcucaaccccaccgccaucuuccugacgacccugagccgcaccuccaagaagcggagcuggccgcucaacgaggcgaucauggccgugggcauggucuccauccuggccagcucccugcucaagaacgacauccccaugaccggcccccugguggccgggggccugcucacggugugcuacguccugaccgggcgcagcgccgaccuggagcucgagcgggcggccgacgugcgcugggaggagcaggccgagaucagcggcuccagccccauccuguccaucaccaucagcgaggacggguccaugagcaucaagaacgaggaggaggagcagacccugacgauccucauccggaccggccugcuggugaucuccggccucuucccggucagcauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacagccagaucggcgccggcguguacaaggaggggaccuuccacaccauguggcacgucacgcgcggcgcggugcugaugcacaaggggaagcggaucgagcccuccugggccgacgugaagaaggaccucaucagcuacggcgggggcuggaagcuggagggcgaguggaaggagggggaggagguccaggugcuggcccucgagcccggcaagaacccccgcgccgugcagaccaagcccgggcuguucaagaccaacaccggcacgaucggggccgucucccuggacuucagccccggcaccuccggcagccccaucguggacaagaaggggaagguggucggccucuacgggaacggcguggugacccgguccggcaccuacgucagcgcgaucgcccagacggagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcguggucgccgccgagauggaggaggcccuccgcggccugcccauccgguaccagacccccgcgauccgcgccgagcacaccgggcgggagaucguggaccugaugugccacgccaccuucacgaugcgccuccugagccccauccgggugccgaacuacaaccugaucaucauggacgaggcccacuucaccgaccccgccagcaucgcggcccgcggcuacaucuccacccgggucgagaugggcgaggccgccgggaucuucaugaccgccacgccgcccggcagccgcgacccguucccccaguccaacgcgcccaucauggacgaggagcgggagauccccgagcgcagcuggaacuccgggcacgagugggugaccgacuucaagggcaagaccgugugguucgucccgagcaucaaggccgggaacgacaucgccgccugccuccggaagaacggcaagaaggugauccagcugucccgcaagaccuucgacagcgaguacaucaagacgcggaccaacgacugggacuucguggucaccaccgacaucuccgagaugggcgcgaacuucaaggccgagcgcgugaucgacccccggcgcugcaugaagcccgugauccugacggacggggaggagcgggucauccucgccggccccaugccggugacccacagcuccgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccgagcauguucgagcccgagcgggagaaggucgacgccaucgacggcgaguaccgccugcgcggggaggcccgcaagaccuucguggaccugaugcggcgcggcgaccuccccgucuggcuggccuacaagguggcggccgaggggaucaacuacgccgaccggcgcuggugcuucgacggcgugaagaacaaccagauccuggaggagaacgucgagguggagaucuggacgaaggagggggagcggaagaagcucaagccgcgcuggcuggacgcccggaucuacuccgacccccuggcccucaaggaguucaaggaguucgcggccggccgcaagagccugacccugaaccucaucaccgagaugggccggcugcccaccuucaugacgcagaaggccaagaacgcccuggacaaccucgcggugcugcacaccgccgaggccgggggccgcgccuacaaccacgcccuguccgagcuccccgagacccuggagacccugcuccugcugacgcuccuggcgaccgucaccgggggcaucuuccuguuccucaugagcggcaaggggaucggcaagaugacccuggggaugugcugcaucaucaccgccuccauccugcucugguacgcccagauccagccgcacuggaucgccgccagcaucauccuggaguucuuccugaucgugcuccugauccccgagcccgagaagcagcggacgccccaggacaaccagcugaccuacguggucaucgcgauccucaccgugguggccgccaccauggccaacgagaugggcuuccuggagaagacgaagaaggacuucgggcugggcuccaucaccacccagcagccggagagcaacauccucgacaucgaccugcgccccgccagcgcguggacccuguacgccgucgccacgaccuucaucacccccaugcuccggcacuccaucgagaacagcuccgugaacgugagccugaccgccaucgccaaccaggcgacgguccugaugggccucgggaagggcuggccccuguccaagauggacaucggggugccgcugcucgccaucggcugcuacagccaggugaaccccaucacccugaccgccgcccugcuccugcuggucgcgcacuacgccaucaucgggcccggccuccaggccaaggccacccgcgaggcccagaagcgggcggccgccggcaucaugaagaaccccacgguggacgggaucaccgugaucgaccuggacccgauccccuacgaccccaaguucgagaagcagcugggccaggucaugcuccuggugcugugcgugacccagguccucaugaugcgcaccacgugggcccugugcgaggcccugacccucgcgaccgggcccaucuccacccugugggagggcaacccggggcgguucuggaacacgaccaucgccgugagcauggccaacaucuuccgcggcuccuaccuggccggcgccgggcuccuguucagcaucaugaagaacaccgcgaacacccgccggggcacggggaacaccggcgagacccugggcgagaaguggaagaaccgccucaacgcccuggggaaguccgaguuccagaucuacaagaaguccggcauccaggagguggaccggacccuggccaaggaggggaucaagcgcggcgagacggaccaccacgccgucucccgggggagcgcgaagcuccgcugguucguggagcggaaccuggugacccccgagggcaaggucguggaccugggcugcgggcgcggcgggugguccuacuacugcggcgggcucaagaacgugaaggaggucaagggccugaccaagggcgggcccggccacgaggagcccaucccgaugagcaccuacggguggaaccuggugcggcuccaguccggcguggacgucuucuucacgccgcccgagaagugcgacacccugcugugcgacaucggggagagcucccccaacccgaccguggaggccggccgcacccuccgggugcugaaccuggccgagaacuggcucaacaacaacacccaguucugcaucaagguccugaaccccuacaugcccagcgugaucgagaagauggaggcccugcagcgcaaguacggcggggcccuggugcggaacccgcucagccgcaacuccacgcacgagauguacugggucagcaacgcguccggcaacaucgugagcuccgugaacaugaucagccggaugcugaucaaccgcuucaccaugcggcacaagaaggccaccuacgagcccgacgucgaccugggguccggcacccgcaacaucgggaucgagagcgagacgcccaaccucgacaucaucggcaagcggaucgagaagaucaagcaggagcacgagaccuccuggcacuacgaccaggaccaccccuacaagaccugggccuaccacggcagcuacgagaccaagcagacgggguccgccagcuccauggugaacggcgugguccgccugcugaccaagccgugggacgugauccccauggugacccagauggccaugaccgacacgacccccuucgggcagcagcgcgucuucaaggagaagguggacacccggacccaggagcccaaggagggcacgaagaagcucaugaagaucaccgcggaguggcuguggaaggagcugggcaagaagaagaccccgcgcaugugcacccgggaggaguucacgcgcaagguccggagcaacgccgcccucggggccaucuucaccgacgagaacaaguggaaguccgcccgcgaggcgguggaggacagcggcuucugggagcugguggacaaggagcggaaccugcaccucgaggggaagugcgagaccugcgucuacaacaugaugggcaagcgcgagaagaagcugggggaguucggcaaggccaagggcucccgggccaucugguacauguggcugggggcccgcuuccucgaguucgaggcgcugggcuuccugaacgaggaccacugguucagccgggagaacucccucagcgggguggagggcgaggggcugcacaagcugggcuacauccuccgcgacgugagcaagaaggagggcggggccauguacgccgacgacaccgccggcugggacacgcggaucacccuggaggaccugaagaacgaggagauggucaccaaccacauggagggggagcacaagaagcucgccgaggcgaucuucaagcugaccuaccagaacaagguggugcgcguccagcggcccacgccccgcggcaccgugauggacaucaucucccggcgcgaccagcgggggagcggccagguggucaccuacggccugaacaccuucacgaacauggaggcccagcucauccgccagauggagggggagggcguguucaaguccauccagcagcugaccgugaaggaggagaucgccgucaagaacuggcugauccggguggggcgcgagcgccucagccggauggccaucuccggcgacgacugcguggucaagccccuggacgaccgcuucgccagcgcgcugaccgcccucaacgacaugggcaaggugcggaaggacauccagcagugggagccgucccgcggguggaacgacuggacccaggugcccuucugcagccaccacuuccacgagcugaucaugaaggacggccggguccugguggugcccugccgcaaccaggacgagcucaucgggcgggcccgcaucucccagggcgccggguggagccugcgggagacggccugccugggcaaguccuacgcgcagauguggagccucauguacuuccaccgccgggaccugcgccuggccgccaacgccaucugcuccgccguccccagccacugggugccgaccucccggaccaccuggagcauccacgcgacccacgaguggaugacgaccgaggacaugcucaccguguggaaccgcgucuggauccaggagaaccccuggauggaggacaagacccccguggaguccugggaggagauccccuaccugggcaagcgggaggaccaguggugcgggagccugaucggccucacgagccgcgccaccugggccaagaacauccagaccgccaucaaccaggugcggucccugaucgggaacgaggaguacaccgacuacaugccgagcaugaagcgcuuccggcgcgaggaggaggaggcgggcguccugugguga

SEQ ID NO: 9706 - RNA, 9876 nt, Artificial Sequence
  derived and/or modified CDS sequence (opt1) from DENV-2__JN851113__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgugauggugcaggcggacuccgggugcgucgugagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgucacccgccuggagaaccugauguggaagcagaucacccccgagcucaaccacauccugaccgagaacgaggugaagcugacgaucaugaccggggacaucaagggcaucaugcaggccgggaagcggucccuccgcccgcagcccaccgagcugaaguacagcuggaaggcguggggcaaggccaagaugcuguccaccgagcuccacaaccacacguuccugaucgacggccccgagaccgccgagugcccgaacaccaaccgggccuggaacagccuggagguggaggacuacggguucggcgucuucaccacgaacaucuggcucaagcugaaggagcgccaggacguguucugcgacuccaagcugaugagcgccgcgaucaaggacaaccgggccgugcacgccgacaugggguacuggaucgaguccgcccucaacgacaccuggaagaucgagaaggccagcuucaucgaggucaaguccugccacuggcccaagagccacacccugugguccaacggcgugcuggagagcgagaugaucauccccaagaacuucgcgggccccgugucccagcacaacuaccgcccgggguaccacacccagaccgccggccccuggcaccucgggcggcuggagauggacuucgacuucugcgagggcacgaccgucguggugaccgaggacugcgggaaccgcggccccagccugcggaccacgaccgccagcggcaagcucaucaccgaguggugcugccgcuccugcacccugcccccgcugcgguaccgcggggaggacggcugcugguacgggauggagauccggccccucaaggagaaggaggagaaccuggucaacagccuggugacggccggccacgggcagaucgacaacuucucccucggcgugcugggcauggcgcuguuccucgaggagaugcugcgcacccgggucgggaccaagcacgccauccugcucguggccgugagcuucgucacccugaucacgggcaacauguccuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccagcaaggagcugaugaugaccaccaucgggaucguccugcucucccagagcacgauccccgaguccauccuggagcugaccgacgcccucgcgcugggcaugauggugcugaagaucguccggaacauggagaaguaccagcucgccgugaccaucauggccauccugugcgugccgaacgccgucauccugcagaacgccuggaaggugagcugcaccacgcucgcgguggucuccgugagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgugggcauggucagcauccuggccuccagccugcucaagaacgacauccccaugaccggcccccugguggccgggggccugcucacggugugcuacguccugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccggucuccauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacucccagaucggcgccggcguguacaaggaggggaccuuccacaccauguggcacgucacgcgcggcgcggugcugaugcacaaggggaagcggaucgagcccagcugggccgacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagaccaacaccggcacgaucggggccgucagccuggacuucucccccggcaccagcggcucccccaucguggacaagaaggggaagguggucggccucuacgggaacggcguggugacccggagcggcaccuacgucuccgcgaucgcccagacggagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcguggucgccgccgagauggaggaggcccuccgcggccugcccauccgguaccagacccccgcgauccgcgccgagcacaccgggcgggagaucguggaccugaugugccacgccaccuucacgaugcgccuccugagccccauccgggugccgaacuacaaccugaucaucauggacgaggcccacuucaccgaccccgccuccaucgcggcccgcggcuacaucagcacccgggucgagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugaccgacuucaagggcaagaccgugugguucgucccguccaucaaggccgggaacgacaucgccgccugccuccggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccccggcgcugcaugaagcccgugauccugacggacggggaggagcgggucauccucgccggccccaugccggugacccacuccagcgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgggagaaggucgacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgugaagaacaaccagauccuggaggagaacgucgagguggagaucuggacgaaggagggggagcgcaagaagcucaagccgcgguggcuggacgcccgcaucuacagcgacccccuggcccucaaggaguucaaggaguucgcggccggccggaagucccugacccugaaccucaucaccgagaugggccgccugcccaccuucaugacgcagaaggccaagaacgcccuggacaaccucgcggugcugcacaccgccgaggccgggggccgggccuacaaccacgcccugagcgagcuccccgagacccuggagacccugcuccugcugacgcuccuggcgaccgucaccgggggcaucuuccuguuccucauguccggcaaggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugaccuacguggucaucgcgauccucaccgugguggccgccaccauggccaacgagaugggcuuccuggagaagacgaagaaggacuucgggcugggcagcaucaccacccagcagccggagagcaacauccucgacaucgaccugcggcccgccuccgcguggacccuguacgccgucgccacgaccuucaucacccccaugcuccgccacagcaucgagaacuccagcgugaacgugucccugaccgccaucgccaaccaggcgacgguccugaugggccucgggaagggcuggccccugagcaagauggacaucggggugccgcugcucgccaucggcugcuacucccaggugaaccccaucacccugaccgccgcccugcuccugcuggucgcgcacuacgccaucaucgggcccggccuccaggccaaggccacccgggaggcccagaagcgcgcggccgccggcaucaugaagaaccccacgguggacgggaugaccgugaucgaccuggacccgauccccuacgaccccaaguucgagaagcagcugggccaggucaugcuccuggugcugugcgugacccagguccucaugaugcggaccacgugggcccugugcgaggcccugacccucgcgaccgggcccaucagcacccugugggagggcaacccggggcgcuucuggaacacgaccaucgccguguccauggccaacaucuuccgcggcagcuaccuggccggcgccgggcuccuguucuccaucaugaagaacaccgcgaacacccggcgcggcacggggaacaccggcgagacccugggcgagaaguggaagaaccggcucaacgcccugggcaagagcgaguuccagaucuacaagaaguccggcauccaggagguggaccgcacccuggccaaggaggggaucaagcggggcgagacggaccaccacgccgucagccgcggguccgcgaagcuccggugguucguggagcgcaaccuggugacccccgagggcaaggucguggaccugggcugcgggcggggcggguggagcuacuacugcggcgggcucaagaacgugaaggaggucaagggccugaccaagggcgggcccggccacgaggagcccaucccgauguccaccuacggguggaaccuggugcgccuccagagcggcguggacgucuucuucacgccgcccgagaagugcgacacccugcugugcgacaucggggaguccagccccaacccgaccguggaggccggccggacccuccgcgugcugaaccuggucgagaacuggcucaacaacaacacccaguucugcaucaaggugcugaaccccuacaugcccagcgugaucgagaagauggaggcccugcagcggaaguacggcggggcccugguccgcaacccgcucucccggaacagcacgcacgagauguacuggguguccaacgccagcggcaacaucguguccagcgucaacaugaucucccgcaugcugaucaaccgguucaccaugcgccacaagaaggcgaccuacgagcccgacguggaccuggggagcggcacccggaacaucgggaucgaguccgagacgcccaaccucgacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcugaccaagccgugggacgugauccccauggucacccagauggccaugaccgacacgacccccuucgggcagcagcggguguucaaggagaaggucgacacccgcacccaggagcccaaggagggcacgaagaagcucaugaagaucaccgccgaguggcuguggaaggagcugggcaagaagaagaccccgcggaugugcacccgcgaggaguucacgcggaaggugcgcuccaacgcggcccucggggccaucuucaccgacgagaacaaguggaaguccgcccgggaggccguggaggacuccggcuucugggagcuggucgacaaggagcgcaaccugcaccucgaggggaagugcgagaccugcguguacaacaugaugggcaagcgggagaagaagcugggggaguucggcaaggcgaagggcagccgcgccaucugguacauguggcugggggcccgguuccucgaguucgaggcccugggcuuccugaacgaggaccacugguucucccgcgagaacagccucagcgggguggagggcgaggggcugcacaagcugggcuacauccuccgggacgucuccaagaaggagggcggggcgauguacgccgacgacaccgccggcugggacacgcgcaucacccuggaggaccugaagaacgaggagauggugaccaaccacauggagggggagcacaagaagcucgccgaggccaucuucaagcugaccuaccagaacaaggugguccgggugcagcgccccacgccccggggcaccgugauggacaucaucagccgccgggaccagcgcggguccggccaggucgugaccuacggccugaacaccuucacgaacauggaggcgcagcucauccggcagauggagggggagggcguguucaagagcauccagcagcugaccgucaaggaggagaucgccgugaagaacuggcugauccgcguggggcgcgagcggcucucccgcauggccaucagcggcgacgacugcgucgugaagccccuggacgaccgguucgccuccgcccugaccgcgcucaacgacaugggcaaggugcgcaaggacauccagcagugggagccgagccggggguggaacgacuggacccagguccccuucugcucccaccacuuccacgagcugaucaugaaggacggccgcgugcuggugguccccugccggaaccaggacgagcucaucgggcgcgcccggaucagccagggcgccggguggucccugcgcgagacggccugccugggcaagagcuacgcccagauguggucccucauguacuuccaccggcgcgaccugcggcuggcggccaacgccaucugcagcgccgugcccucccacugggugccgaccagccgcaccaccugguccauccacgccacccacgaguggaugacgaccgaggacaugcucaccgucuggaaccggguguggauccaggagaaccccuggauggaggacaagacccccguggagagcugggaggagauccccuaccugggcaagcgcgaggaccaguggugcgggagccugaucggccucacgucccgggcgaccugggccaagaacauccagaccgccaucaaccagguccgcagccugaucgggaacgaggaguacaccgacuacaugccguccaugaagcgguuccgccgcgaggaggaggaggccggcgugcugugguga

SEQ ID NO: 9707 - RNA, 9876 nt, Artificial Sequence
  derived and/or modified CDS sequence (opt1) from DENV-2__GU370050__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgugauggugcaggcggacuccgggugcgucgugagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgucacccgccuggagaaccugauguggaagcagaucacccccgagcucaaccacauccugaccgagaacgaggugaagcugacgaucaugaccggggacaucaagggcaucaugcaggccgggaagcggucccuccgcccgcagcccaccgagcugaaguacagcuggaaggcguggggcaaggccaagaugcuguccaccgagcuccacaaccacacguuccugaucgacggccccgagaccgccgagugcccgaacaccaaccgggccuggaacagccuggagguggaggacuacggguucggcgucuucaccacgaacaucuggcucaagcugaaggagcgccaggacguguucugcgacuccaagcugaugagcgccgcgaucaaggacaaccgggccgugcacgccgacaugggguacuggaucgaguccgcccucaacgacaccuggaagaucgagaaggccagcuucaucgaggucaaguccugccacuggcccaagagccacacccugugguccaacggcgugcuggagagcgagaugaucauccccaagaacuucgcgggccccgugucccagcacaacuaccgcccgggguaccacacccagaccgccggccccuggcaccucgggcggcuggagauggacuucgacuucugcgagggcacgaccgucguggugaccgaggacugcgggaaccgcggccccagccugcggaccacgaccgccagcggcaagcucaucaccgaguggugcugccgcuccugcacccugcccccgcugcgguaccgcggggaggacggcugcugguacgggauggagauccggccccucaaggagaaggaggagaaccuggucaacagccuggugacggccggccacgggcagaucgacaacuucucccucggcgugcugggcauggcgcuguuccucgaggagaugcugcgcacccgggucgggaccaagcacgccauccugcucguggccgugagcuucgucacccugaucacgggcaacauguccuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccagcaaggagcugaugaugaccaccaucgggaucguccugcucucccagagcacgauccccgaguccauccuggagcugaccgacgcccucgcgcugggcaugauggugcugaagaucguccggaacauggagaaguaccagcucgccgugaccaucauggccauccugugcgugccgaacgccgucauccugcagaacgccuggaaggugagcugcaccacgcucgcgguggucuccgugagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgugggcauggucagcauccuggccuccagccugcucaagaacgacauccccaugaccggcccccugguggccgggggccugcucacggugugcuacguccugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccggucuccauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacucccagaucggcgccggcguguacaaggaggggaccuuccacaccauguggcacgucacgcgcggcgcggugcugaugcacaaggggaagcggaucgagcccagcugggccgacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagaccaacaccggcacgaucggggccgucagccuggacuucucccccggcaccagcggcucccccaucguggacaagaaggggaagguggucggccucuacgggaacggcguggugacccggagcggcaccuacgucuccgcgaucgcccagacggagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcguggucgccgccgagauggaggaggcccuccgcggccugcccauccgguaccagacccccgcgauccgcgccgagcacaccgggcgggagaucguggaccugaugugccacgccaccuucacgaugcgccuccugagccccauccgggugccgaacuacaaccugaucaucauggacgaggcccacuucaccgaccccgccuccaucgcggcccgcggcuacaucagcacccgggucgagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugaccgacuucaagggcaagaccgugugguucgucccguccaucaaggccgggaacgacaucgccgccugccuccggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccccggcgcugcaugaagcccgugauccugacggacggggaggagcgggucauccucgccggccccaugccggugacccacuccagcgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgggagaaggucgacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgugaagaacaaccagauccuggaggagaacgucgagguggagaucuggacgaaggagggggagcgcaagaagcucaagccgcgguggcuggacgcccgcaucuacagcgacccccuggcccucaaggaguucaaggaguucgcggccggccggaagucccugacccugaaccucaucaccgagaugggccgccugcccaccuucaugacgcagaaggccaagaacgcccuggacaaccucgcggugcugcacaccgccgaggccgggggccgggccuacaaccacgcccugagcgagcuccccgagacccuggagacccugcuccugcugacgcuccuggcgaccgucaccgggggcaucuuccuguuccucauguccggcaaggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugaccuacguggucaucgcgauccucaccgugguggccgccaccauggccaacgagaugggcuuccuggagaagacgaagaaggacuucgggcugggcagcaucaccacccagcagccggagagcaacauccucgacaucgaccugcggcccgccuccgcguggacccuguacgccgucgccacgaccuucaucacccccauccuccgccacagcaucgagaacuccagcgugaacgugucccugaccgccaucgccaaccaggcgacgguccugaugggccucgggaagggcuggccccugagcaagauggacaucggggugccgcugcucgccaucggcugcuacucccaggugaaccccaucacccugaccgccgcccugcuccugcuggucgcgcacuacgccaucaucgggcccggccuccaggccaaggccacccgggaggcccagaagcgcgcggccgccggcaucaugaagaaccccacgguggacgggaugaccgugaucgaccuggacccgauccccuacgaccccaaguucgagaagcagcugggccaggucaugcuccuggugcugugcgugacccagguccucaugaugcggaccacgugggcccugugcgaggcccugacccucgcgaccgggcccaucagcacccugugggagggcaacccggggcgcuucuggaacacgaccaucgccguguccauggccaacaucuuccgcggcagcuaccuggccggcgccgggcuccuguucuccaucaugaagaacaccgcgaacacccggcgcggcacggggaacaccggcgagacccugggcgagaaguggaagaaccggcucaacgcccugggcaagagcgaguuccagaucuacaagaaguccggcauccaggagguggaccgcacccuggccaaggaggggaucaagcggggcgagacggaccaccacgccgucagccgcggguccgcgaagcuccggugguucguggagcgcaaccuggugacccccgagggcaaggucguggaccugggcugcgggcggggcggguggagcuacuacugcggcgggcucaagaacgugaaggaggucaagggccugaccaagggcgggcccggccacgaggagcccaucccgauguccaccuacggguggaaccuggugcgccuccagagcggcguggacgucuucuucacgccgcccgagaagugcgacacccugcugugcgacaucggggaguccagccccaacccgaccguggaggccggccggacccuccgcgugcugaaccuggucgagaacuggcucaacaacaacacccaguucugcaucaaggugcugaaccccuacaugcccagcgugaucgagaagauggaggcccugcagcggaaguacggcggggcccugguccgcaacccgcucucccggaacagcacgcacgagauguacuggguguccaacgccagcggcaacaucguguccagcgucaacaugaucucccgcaugcugaucaaccgguucaccaugcgccacaagaaggcgaccuacgagcccgacguggaccuggggagcggcacccggaacaucgggaucgaguccgagacgcccaaccucgacaucaucggcaagcgcaucgagaagaucaagcaggagcacaagaccagcuggcacuacgaccaggaccaccccuacaagaccugggccuaccacggcuccuacgagaccaagcagacggggagcgccuccagcauggugaacggcgucgugcgccugcugaccaagccgugggacgugauccccauggucacccagauggccaugaccgacacgacccccuucgggcagcagcggguguucaaggagaaggucgacacccgcacccaggagcccaaggagggcacgaagaagcucaugaagaucaccgccgaguggcuguggaaggagcugggcaagaagaagaccccgcggaugugcacccgcgaggaguucacgcggaaggugcgcuccaacgcggcccucggggccaucuucaccgacgagaacaaguggaaguccgcccgggaggccguggaggacuccggcuucugggagcuggucgacaaggagcgcaaccugcaccucgaggggaagugcgagaccugcguguacaacaugaugggcaagcgggagaagaagcugggggaguucggcaaggcgaagggcagccgcgccaucugguacauguggcugggggcccgguuccucgaguucgaggcccugggcuuccugaacgaggaccacugguucucccgcgagaacagccucagcgggguggagggcgaggggcugcacaagcugggcuacauccuccgggacgucuccaagaaggagggcggggcgauguacgccgacgacaccgccggcugggacacgcgcaucacccuggaggaccugaagaacgaggagauggugaccaaccacauggagggggagcacaagaagcucgccgaggccaucuuccggcugaccuaccagaacaaggugguccgcgugcagcggcccacgccccgcggcaccgugauggacaucaucagccggcgcgaccagcggggguccggccaggucgugaccuacggccugaacaccuucacgaacauggaggcgcagcucauccgccagauggagggggagggcguguucaagagcauccagcagcugaccgucaaggaggagaucgccgugaagaacuggcugauccgcguggggcgggagcgccucucccggauggccaucagcggcgacgacugcgucgugaagccccuggacgaccgcuucgccuccgcccugaccgcgcucaacgacaugggcaaggugcggaaggacauccagcagugggagccgagccgcggguggaacgacuggacccagguccccuucugcucccaccacuuccacgagcugaucaugaaggacggccgggugcuggugguccccugccgcaaccaggacgagcucaucgggcgggcccgcaucagccagggcgccggguggucccugcgggagacggccugccugggcaagagcuacgcccagauguggucccucauguacuuccaccgccgggaccugcgccuggcggccaacgccaucugcagcgccgugcccucccacugggugccgaccagccggaccaccugguccauccacgccacccacgaguggaugacgaccgaggacaugcucaccgucuggaaccgcguguggauccaggagaaccccuggauggaggacaagacccccguggagagcugggaggagauccccuaccugggcaagcgggaggaccaguggugcgggagccugaucggccucacgucccgcgcgaccugggccaagaacauccagaccgccaucaaccagguccggagccugaucgggaacgaggaguacaccgacuacaugccguccaugaagcgcuuccgccgggaggaggaggaggccggcgugcugugguga

SEQ ID NO: 9708 - RNA, 9876 nt, Artificial Sequence
  derived and/or modified CDS sequence (opt1) from DENV-2__JN851129__SS-prME
accgcggggaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacacgaucaccuacaacugcccccugcuccgccagaacgagcccgaggacaucgacugcuggugcaacagcaccuccaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugagcgaggagcaggacaagcgcuucgugugcaagcacuccauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacagcggcgaggagaacgccguggggaacgacacgggcaagcacgggaaggagaucaaggucaccccgcaguccagcaucaccgaggccgagcugaccggcuacgggaccgugacgauggagugcagcccccggaccggccuggacuucaacgagauggugcuccugcagauggagaacaaggccuggcugguccaccggcagugguuccucgaccugccccugcccuggcucccgggcgcggacacccaggggagcaacuggauccagaaggagacccuggugacguucaagaacccccacgccaagaagcaggacgucguggugcugggcagccaggagggggccaugcacaccgcccucaccggcgccaccgagauccagauguccagcgggaaccugcuguucacgggccaccucaagugccgccugcggauggacaagcugcagcucaagggcauguccuacagcaugugcaccgggaaguucaaggucgugaaggagaucgcggagacccagcacggcaccaucgugauccgcguccaguacgagggggacggcucccccugcaagauccccuucgagaucauggaccuggagaagcggcacgugcugggccgccucaucacggugaacccgaucgucaccgagaaggacagccccgugaacaucgaggccgagccgcccuucggggacuccuacaucaucaucggcguggagccggggcagcugaagcugagcugguucaagaagggcuccagcaucgggcagauguucgagaccaccaugcgcggcgccaagcggauggccauccucggcgacacggccugggacuucgggucccugggcggggucuucaccagcaucggcaaggcgcugcaccagguguucggggccaucuacggcgccgccuucuccggcgugagcuggaccaugaagauccucaucggggucgugaucaccuggaucggcaugaacucccgcagcacgucccugagcgugucccugguccugguggggguggucacccucuaccugggcgugauggugcaggcggacagcgggugcgucgugagcuggaagaacaaggagcugaagugcggcuccggcaucuucaucaccgacaacgugcacaccuggacggagcaguacaaguuccagcccgagagccccuccaagcucgccagcgccauccagaaggcccacgaggaggggaucugcggcauccgguccgucacccgccuggagaaccugauguggaagcagaucacccccgagcucaaccacauccugagcgagaacgaggugaagcugaccaucaugacgggggacaucaagggcaucaugcaggccgggaagcggucccuccgcccgcagcccaccgagcugaaguacagcuggaaggcguggggcaaggccaagaugcuguccaccgagcuccacaaccacaccuuccugaucgacggccccgagacggccgagugcccgaacaccaaccgggccuggaacagccuggagguggaggacuacggguucggcgucuucaccaccaaccucuggcugaagcugaaggagcgccaggacguguucugcgacuccaagcucaugagcgccgcgaucaaggacaaccgggccgugcacgccgacaugggguacuggaucgaguccgcccugaacgacacguggaagaucgagaaggccagcuucaucgaggucaaguccugccacuggcccaagagccacacccugugguccaacggcgugcucgagagcgagaugaucauccccaagagcuucgcgggccccgugucccagcacaacuaccgcccgggguaccacacccagaccgccggccccuggcaccuggggcggcuggagauggacuucgacuucugcgagggcaccacggucguggugaccgaggacugcgggaaccgcggccccagccuccggaccaccacggccuccggcaagcugaucaccgaguggugcugccgcagcugcacccugcccccgcuccgguaccgcggggaggacggcugcugguacgggauggagauccggccccugaaggagaaggaggagaaccuggucaacucccucgugaccgccggccacgggcagaucgacaacuucagccugggcgugcugggcauggcccucuuccuggaggagaugcugcgcacgcgggucgggaccaagcacgccauccuccugguggccguguccuucgucacccugaucaccggcaacaugagcuuccgcgaccucgggcgcgugauggugauggucggcgccacgaugaccgacgacaucgggaugggcgugaccuaccuggcccugcucgcggccuucaaggugcggcccaccuucgccgccggccugcugcuccgcaagcugacguccaaggagcugaugaugaccaccaucgggaucguccuccugagccaguccaccauccccgagacgauccuggagcucaccgacgcccuggcgcugggcaugauggugcucaagaucguccggaacauggagaaguaccagcuggccgugaccaucauggccauccugugcgugccgaacgccgucauccuccagaacgccuggaaggugagcugcaccacgcuggcgguggucuccgugagcccccugcuccugaccuccagccagcagaaggccgacuggaucccccuggcccucaccaucaaggggcugaaccccaccgccaucuuccugacgacccucucccgcaccagcaagaagcgguccuggccgcugaacgaggcgaucauggccgugggcauggucagcauccuggccagcucccuccugaagaacgacauccccaugaccggcccccugguggccgggggccuccugacggugugcuacguccugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgugaucagcggccuguucccggucuccauccccaucaccgccgccgcgugguaccugugggaggugaagaagcagcgcgccggggugcucugggacguccccuccccgccgcccgugggcaaggccgagcuggaggacggggccuaccggaucaagcagaagggcauccugggguacucccagaucggcgccggcguguacaaggaggggaccuuccacaccauguggcacgucacgcgcggcgcggugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccccgcgccgugcagaccaagcccgggcuguucaagaccaacaccggcacgaucggggccgucagccucgacuucucccccggcaccagcggcucccccaucguggacaagaaggggaagguggucggccuguacgggaacggcguggugacccggagcggcaccuacgucagcgcgaucgcccagacggagaaguccaucgaggacaaccccgagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgccccgacgcgcguggucgccgccgagauggaggaggcccugcgcggccugcccauccgguaccagacccccgcgauccgcgccgagcacaccgggcgggagaucguggaccucaugugccacgccaccuucacgaugcgccugcugagccccauccgggugccgaacuacaaccucaucaucauggacgaggcccacuucaccgaccccgccuccaucgcggcccgcggcuacaucagcacccgggucgagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugaccgacuucaagggcaagaccgugugguucgucccguccaucaaggccgggaacgacaucgccgccugccugcggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccccggcgcugcaugaagcccgugauccucacggacggggaggagcgggucauccuggccggccccaugccggugacccacuccagcgccgcccagcgccgggggcgcgugggccgcaaccccaagaacgagaacgaccaguacaucuacaugggggagccccuggagaacgacgaggacugcgcgcacuggaaggaggccaagaugcuccuggacaacaucaacacccccgagggcaucaucccguccauguucgagcccgagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcaucaagaacaaccagauccucgaggagaacguggaggucgagaucuggacgaaggagggggagcgcaagaagcugaagccgcgguggcuggacgcccgcaucuacagcgacccccucgcccugaaggaguucaaggaguucgcggccggccggaagucccugacccucaaccugaucaccgagaugggccgccugcccaccuucaugacgcagaaggcccggaacgcccucgacaaccuggcggugcugcacaccgccgaggccgggggccgcgccuacaaccacgcccucagcgagcugcccgagacccuggagacccuccugcugcucacgcugcuggcgaccgugaccgggggcaucuuccucuuccugauguccggcaaggggaucggcaagaugacccuggggaugugcugcaucaucaccgccagcauccuccugugguacgcccagauccagccgcacuggaucgccgccagcaucauccuggaguucuuccucaucguccugcugauccccgagcccgagaagcagcggacgccccaggacaaccagcucaccuacguggugaucgcgauccugaccgucguggccgccaccauggccaacgagaugggcuuccuggagaagacgaagaaggacuucgggcucggcuccaucaccacccagcagccggagagcaacauccuggacaucgaccugcgccccgccuccgcguggacccucuacgccguggccacgaccuucaucacccccaugcugcggcacagcaucgagaacuccagcgucaacgugucccugaccgccaucgccaaccaggcgacggugcucaugggccuggggaagggcuggccccugagcaagauggacaucggggucccgcuccuggccaucggcugcuacucccaggugaaccccaucacccugaccgccgcccuccugcugcucguggcgcacuacgccaucaucgggcccggccugcaggccaaggccacccgcgaggcccagaagcgggcggccgccggcaucaugaagaaccccacggucgacgggaucaccgugaucgaccuggacccgauccccuacgaccccaaguucgagaagcagcucggccaggugaugcugcugguccucugcgugacccaggugcugaugaugcgcaccacgugggcccugugcgaggcccucacccuggcgaccgggcccaucagcacccugugggagggcaacccggggcgcuucuggaacacgaccaucgccgucuccauggccaacaucuuccggggcagcuaccucgccggcgccgggcugcuguucuccaucaugaagaacaccgcgaacacccgccggggcacggggaacaccggcgagacccucggcgagaaguggaagaaccgccugaacgcccugggcaagagcgaguuccagaucuacaagaaguccggcauccaggagguggaccggacccucgccaaggaggggaucaagcgcggcgagacggaccaccacgccgugagccggggguccgcgaagcugcgcugguucgucgagcggaaccuggugacccccgagggcaagguggucgaccucggcugcgggcgcggcggguggagcuacuacugcggcgggcugaagaacgugaaggaggugaagggccugaccaagggcgggcccggccacgaggagcccaucccgauguccaccuacggguggaaccucguccggcugcagagcggcguggacguguucuucacgccgcccgagaagugcgacacccugcucugcgacaucggggagagcucccccaacccgaccgucgaggccggccgcacccugcgggugcugaaccucguggagaacuggcugaacaacaacacccaguucugcaucaagguccugaaccccuacaugcccagcgugaucgagaagauggaggcccugcagcgcaaguacggcggggcccucgugcggaacccgcugucccgcaacagcacgcacgagauguacugggucuccaacgccagcggcaacaucguguccagcgugaacaugaucucccggaugcugaucaaccgcuucaccaugcggcacaagaaggcgaccuacgagcccgacgucgaccucgggagcggcacccgcaacaucgggaucgaguccgagacgcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgugguccggcugcucaccaagccgugggacaucauccccauggugacccagauggccaugaccgacacgacccccuucgggcagcagcgcguguucaaggagaaggucgacacccggacccaggagcccaaggagggcacgaagaagcugaugaagaucaccgccgaguggcuguggaaggagcucggcaagaagaagaccccgcgcaugugcacccgggaggaguucacgcgcaaggugcgguccaacgcggcccugggggccaucuucaccgacgagaacaaguggaaguccgcccgcgaggccgucgaggacuccggcuucugggagcugguggacaaggagcggaaccuccaccuggaggggaagugcgagaccugcguguacaacaugaugggcaagcgcgagaagaagcugggggaguucggcaaggcgaagggcagccgggccaucugguacauguggcucggggcccgcuuccuggaguucgaggcccugggcuuccucaacgaggaccacugguucagccgggagaacucccugagcggggucgagggcgaggggcugcacaagcucggcuacauccugcgcgacguguccaagaaggagggcggggcgauguacgccgacgacaccgccggcugggacacgcggaucacccuggaggaccucaagaacgaggagauggugaccaaccacauggagggggagcacaagaagcuggccgaggccaucuucaagcugaccuaccagaacaaggucgugcgcgugcagcggcccacgccccgcggcaccgucauggacaucaucagccggcgcgaccagcggggguccggccagguggugaccuacggccucaacaccuucacgaacauggaggcgcagcugauccgccagauggagggggagggcgucuucaagagcauccagcagcugaccgugaccgaggagaucgccgugaagaacuggcucguccgcguggggcgggagcgccugucccggauggccaucagcggcgacgacugcguggucaagccccuggacgaccgcuucgccuccgcccucaccgcgcugaacgacaugggcaaggugcggaaggacauccagcagugggagccgagccgcggguggaacgacuggacccaggugcccuucugcucccaccacuuccacgagcugaucaugaaggacggccggguccucguggugcccugccgcaaccaggacgagcugaucgggcgggcccgcaucagccagggcgccggguggucccugcgggagaccgccugccucggcaagagcuacgcccagauguggucccugauguacuuccaccgccgggaccugcgccucgcggccaacgccaucugcagcgccguccccucccacugggugccgaccagccggaccaccuggagcauccacgccacgcacgaguggaugaccaccgaggacaugcugaccguguggaaccgcgucuggauccaggagaaccccuggauggaggacaagacgcugguggaguccugggaggagauccccuaccucggcaagcgggaggaccaguggugcgggagccugaucggccugaccucccgcgcgaccugggccaagaacauccagaccgccaucaaccaggugcggagccucaucgggaacgaggaguacacggacuacaugcccuccaugaagcgcuuccgccgggaggaggaggaggccggcguccugugguga

SEQ ID NO: 9709 - RNA, 9876 nt, Artificial Sequence
  derived and/or modified CDS sequence (opt1) from DENV-2__JN851128__SS-prME
accgccggcaucaucaucaugaugauccccaccgugauggccuuccaccugaccacccgcaacggggagccccacaugaucgucagccggcaggagaagggcaagucccuccuguucaagaccgagaacggggugaacaugugcacccugauggcgauggaccucggcgagcugugcgaggacacgaucaccuacaacugcccccugcuccgccagaacgagcccgaggacaucgacugcuggugcaacagcaccuccaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaaccaccccgccacccugcgcaaguacugcaucgaggccaagcucaccaacacgaccaccgcgagccggugcccgacccagggggagcccucccugagcgaggagcaggacaagcgcuucgugugcaagcacuccauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacagcggcgaggagaacgccguggggaacgacacgggcaagcacgggaaggagaucaaggucaccccgcaguccagcaucaccgaggccgagcugaccggcuacgggaccgugacgauggagugcagcccccggaccggccuggacuucaacgagauggugcuccugcagauggagaacaaggccuggcugguccaccggcagugguuccucgaccugccccugcccuggcucccgggcgcggacacccaggggagcaacuggauccagaaggagacccuggugacguucaagaacccccacgccaagaagcaggacgucguggugcugggcagccaggagggggccaugcacaccgcccucaccggcgccaccgagauccagauguccagcgggaaccugcuguucacgggccaccucaagugccgccugcggauggacaagcugcagcucaagggcauguccuacagcaugugcaccgggaaguucaaggucgugaaggagaucgcggagacccagcacggcaccaucgugauccgcguccaguacgagggggacggcucccccugcaagauccccuucgagaucauggaccuggagaagcggcacgugcugggccgccucaucacggugaacccgaucgucaccgagaaggacagccccgugaacaucgaggccgagccgcccuucggggacuccuacaucaucaucggcguggagccggggcagcugaagcugagcugguucaagaagggcuccagcaucgggcagauguucgagaccaccaugcgcggcgccaagcggauggccauccucggcgacacggccugggacuucgggucccugggcggggucuucaccagcaucggcaaggcgcugcaccagguguucggggccaucuacggcgccgccuucuccggcgugagcuggaccaugaagauccucaucggggucgugaucaccuggaucggcaugaacucccgcagcacgucccugagcgugucccugguccugguggggguggucacccucuaccugggcgugauggugcaggcggacagcgggugcgucgugagcuggaagaacaaggagcugaagugcggcuccggcaucuucaucaccgacaacgugcacaccuggacggagcaguacaaguuccagcccgagagccccuccaagcucgccagcgccauccagaaggcccacgaggaggggaucugcggcauccgguccgucacccgccuggagaaccugauguggaagcagaucacccccgagcucaaccacauccugagcgagaacgaggugaagcugaccaucaugacgggggacaucaagggcaucaugcaggccgggaagcggucccuccgcccgcagcccaccgagcugaaguacagcuggaaggcguggggcaaggccaagaugcuguccaccgagcuccacaaccacaccuuccugaucgacggccccgagacggccgagugcccgaacaccaaccgggccuggaacagccuggagguggaggacuacggguucggcgucuucaccaccaaccucuggcugaagcugaaggagcgccaggacguguucugcgacuccaagcucaugagcgccgcgaucaaggacaaccgggccgugcacgccgacaugggguacuggaucgaguccgccaucaacgacacguggaagaucgagaaggccagcuucaucgaggucaaguccugccacuggcccaagagccacacccugugguccaacggcgugcuggagagcgagaugaucauccccaagaacuucgcgggccccgugagccagcacaacuaccgcccgggguaccacacccagaccgccggccccuggcaccucgggcggcuggagauggacuucgacuucugcgagggcaccacggucguggugaccgaggacugcgggaaccgcggccccucccugcggaccaccacggccagcggcaagcucaucaccgaguggugcugccgcuccugcacccugcccccgcugcgguaccgcggggaggacggcugcugguacgggauggagauccggccccucaaggagaaggaggagaaccuggucaacagccuggugaccgccggccacgggcagaucgacaacuucucccucggcgugcugggcauggcgcuguuccucgaggagaugcugcgcacgcgggucgggaccaagcacgccauccugcucguggccgugagcuucgucacccugaucaccggcaacauguccuuccgcgaccuggggcgcgugauggugauggucggcgccacgaugaccgacgacaucgggaugggcgugaccuaccucgcccugcuggcggccuucaaggugcggcccaccuucgccgccggccuccugcugcgcaagcucacgagcaaggagcugaugaugaccaccaucgggaucguccugcucucccagagcaccauccccgagacgauccuggagcugaccgacgcccucgcgcugggcaugaugauccugaagaucgugcggaacauggagaaguaccagcucgccgucaccaucauggccauccugugcgugccgaacgccgugauccugcagaacgccuggaaggucuccugcaccacgcucgcgguggugagcgucagcccccugcugcucaccagcucccagcagaaggccgacuggaucccccuggcccugaccaucaaggggcucaaccccaccgccaucuuccugacgacccugagccgcaccuccaagaagcggagcuggccgcucaacgaggcgaucauggccgugggcaugguguccauccuggccagcagccugcucaagaacgacauccccaugaccggcccccuggucgccgggggccugcucacggugugcuacgugcugaccgggcgcuccgccgaccuggagcucgagcgggcggccgacguccgcugggaggagcaggccgagaucagcggcuccagccccauccuguccaucaccaucagcgaggacggguccaugagcaucaagaacgaggaggaggagcagacccugacgauccucauccggaccggccugcuggugaucuccggccucuucccggugagcauccccaucaccgccgccgcgugguaccugugggaggucaagaagcagcgcgccggggugcugugggacgugcccagcccgccgcccgucggcaaggccgagcucgaggacggggccuaccggaucaagcagaagggcauccugggguacagccagaucggcgccggcguguacaaggaggggaccuuccacaccauguggcacgugacgcgcggcgcgguccugaugcacaaggggaagcggaucgagcccuccugggccgacgugaagaaggaccucaucagcuacggcgggggcuggaagcuggagggcgaguggaaggagggggaggaggugcagguccuggcccucgagcccggcaagaacccccgcgccgugcagaccaagcccgggcuguucaagaccaacaccggcacgaucggggccgugucccuggacuucagccccggcaccuccggcagccccaucgucgacaagaaggggaagguggugggccucuacgggaacggcgucgugacccgguccggcaccuacgugagcgcgaucgcccagacggagaaguccaucgaggacaaccccgagaucgaggacgacaucuuccgcaagaagcggcugaccaucauggaccugcaccccggggccggcaagaccaagcgcuaccugcccgccaucguccgggaggcgaucaagcgcgggcuccggacccugauccuggccccgacgcgcgugguggccgccgagauggaggaggcccuccgcggccugcccauccgguaccagacccccgcgauccgcgccgagcacaccgggcgggagaucgucgaccugaugugccacgccaccuucacgaugcgccuccugucccccauccgggugccgaacuacaaccugaucaucauggacgaggcccacuucaccgaccccgccagcaucgcggcccgcggcuacaucuccacccggguggagaugggcgaggccgccgggaucuucaugaccgccacgccgcccggcagccgcgacccguucccccaguccaacgcgcccaucauggacgaggagcgggagauccccgagcgcagcuggaacuccgggcacgagugggucaccgacuucaagggcaagaccgugugguucgugccgagcaucaaggccgggaacgacaucgccgccugccuccggaagaacggcaagaaggucauccagcugucccgcaagaccuucgacagcgaguacaucaagacgcggaccaacgacugggacuucguggugaccaccgacaucuccgagaugggcgcgaacuucaaggccgagcgcgucaucgacccccggcgcugcaugaagcccgugauccugacggacggggaggagcgggugauccucgccggccccaugccggucacccacagcuccgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccgagcauguucgagcccgagcgggagaagguggacgccaucgacggcgaguaccgccugcgcggggaggcccgcaagaccuucgucgaccugaugcggcgcggcgaccuccccguguggcuggccuaccgggucgcggccgaggggaucaacuacgccgaccgccgguggugcuucgacggcgugaagaacaaccagauccuggaggagaacguggaggucgagaucuggacgaaggagggggagcgcaagaagcucaagccgcgguggcuggacgcccgcaucuacuccgacccccuggcccucaaggaguucaaggaguucgcggccggccggaagucccugacccugaaccucaucaccgagaugggccgccugcccaccuucaugacgcagaaggcccggaacgcccuggacaaccucgcggugcugcacaccgccgaggccgggggccgcgccuacaaccacgcccuguccgagcuccccgagacccuggagacccugcuccugcugacgcuccuggcgaccgugaccgggggcaucuuccuguuccucaugagcggcaaggggaucggcaagaugacccuggggaugugcugcaucaucaccgccuccauccugcucugguacgcccagauccagccgcacuggaucgccgccagcaucauccuggaguucuuccugaucguccuccugauccccgagcccgagaagcagcggacgccccaggacaaccagcugaccuacguggugaucgcgauccucaccgucguggccgccaccauggccaacgagaugggcuuccuggagaagacgaagaaggacuucgggcugggcagcaucaccacccagcagccggaguccaacauccucgacaucgaccugcgccccgccagcgcguggacccuguacgccguggccacgaccuucaucacccccaugcuccggcacuccaucgagaacagcuccgucaacgugagccugaccgccaucgccaaccaggcgacggugcugaugggccucgggaagggcuggccccuguccaagauggacaucggggucccgcugcucgccaucggcugcuacagccaggugaaccccaucacccugaccgccgcccugcuccugcugguggcgcacuacgccaucaucgggcccggccuccaggccaaggccacccgcgaggcccagaagcgggcggccgccggcaucaugaagaaccccacggucgacgggaucaccgugaucgaccuggacccgauccccuacgaccccaaguucgagaagcagcugggccaggugaugcuccugguccugugcgugacccaggugcucaugaugcgcaccacgugggcccugugcgaggcccugacccucgcgaccgggcccaucuccacccugugggagggcaacccggggcgcuucuggaacacgaccaucgccgucagcauggccaacaucuuccggggcuccuaccuggccggcgccgggcuccuguucagcaucaugaagaacaccgcgaacacccgccggggcacggggaacaccggcgagacccugggcgagaaguggaagaaccgccucaacgcccuggggaaguccgaguuccagaucuacaagaaguccggcauccaggagguggaccggacccuggccaaggaggggaucaagcgcggcgagacggaccaccacgccgugucccgggggagcgcgaagcuccgcugguucgucgagcggaaccuggugacccccgagggcaagguggucgaccugggcugcgggcgcggcgggugguccuacuacugcggcgggcucaagaacgugaaggaggugaagggccugaccaagggcgggcccggccacgaggagcccaucccgaugagcaccuacggguggaaccugguccggcuccaguccggcguggacguguucuucacgccgcccgagaagugcgacacccugcugugcgacaucggggagagcagccccaacccgaccgucgaggccggccgcacccuccgggugcugaaccugguggagaacuggcucaacaacaacacccaguucugcaucaagguccugaaccccuacaugcccuccgugaucgagaagauggaggcccugcagcgcaaguacggcggggcccuggugcggaacccgcucagccgcaacuccacgcacgagauguacugggucagcaacgccuccggcaacaucgugagcuccgugaacaugaucagccggaugcugaucaaccgcuucaccaugcggcacaagaaggcgaccuacgagcccgacgucgaccugggguccggcacccgcaacaucgggaucgagagcgagacgcccaaccucgacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgugguccggcugcugaccaagccgugggacaucauccccauggugacccagauggccaugaccgacacgacccccuucgggcagcagcgcguguucaaggagaaggucgacacccggacccaggagcccaaggagggcacgaagaagcucaugaagaucaccgccgaguggcuguggaaggagcugggcaagaagaagaccccgcgcaugugcacccgggaggaguucacgcgcaaggugcggagcaacgcggcccucggggccaucuucaccgacgagaacaaguggaaguccgcccgcgaggccgucgaggacagcggcuucugggagcugguggacaaggagcggaaccugcaccucgaggggaagugcgagaccugcguguacaacaugaugggcaagcgcgagaagaagcugggggaguucggcaaggcgaagggcucccgggccaucugguacauguggcugggggcccgcuuccucgaguucgaggcccugggcuuccugaacgaggaccacugguucagccgggagaacagccucuccggggucgagggcgaggggcugcacaagcugggcuacauccuccgcgacgugagcaagaaggagggcggggcgauguacgccgacgacaccgccggcugggacacgcggaucacccuggaggaccugaagaacgaggagauggugaccaaccacauggagggggagcacaagaagcucgccgaggccaucuucaagcugaccuaccagaacaaggucgugcgcgugcagcggcccacgccccgcggcaccgucauggacaucaucucccggcgcgaccagcgggggagcggccagguggugaccuacggccugaacaccuucacgaacauggaggcgcagcucauccgccagauggagggggagggcgucuucaaguccauccagcagcugaccgugaccgaggagaucgccgugaagaacuggcugguccgcguggggcgggagcgccucagccggauggccaucuccggcgacgacugcguggucaagccccuggacgaccgcuucgccagcgcccugaccgcgcucaacgacaugggcaaggugcggaaggacauccagcagugggagccgucccgcggguggaacgacuggacccaggugcccuucugcagccaccacuuccacgagcugaucaugaaggacggccggguccugguggugcccugccgcaaccaggacgagcucaucgggcgggcccgcaucucccagggcgccggguggagccugcgggagaccgccugccugggcaaguccuacgcccagauguggagccucauguacuuccaccgccgggaccugcgccuggcggccaacgccaucugcuccgccguccccagccacugggugccgaccucccggaccaccuggagcauccacgccacgcacgaguggaugaccaccgaggacaugcucaccguguggaaccgcgucuggauccaggagaaccccuggauggaggacaagacgcugguggagagcugggaggagauccccuaccugggcaagcgggaggaccaguggugcgggucccucaucggccugaccagccgcgcgaccugggccaagaacauccagaccgccaucaaccaggugcggucccugaucgggaacgaggaguacacggacuacaugcccagcaugaagcgcuuccgccgggaggaggaggaggccggcguccucugguga

SEQ ID NO: 9710 - RNA, 9876 nt, Artificial Sequence
  derived and/or modified CDS sequence (opt1) from DENV-2__JN851130__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaagaccuggggcaaggcgaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuucugcgacagcaagcugauguccgccgccaucaaggacaaccgggcggugcacgccgacaugggguacuggaucgagagcgcccucaacgacaccuggaagaucgagaaggccuccuucaucgaggucaagagcugcuacuggcccaagucccacacccuguggagcaacggcgugcuggaguccgagaugaucauccccaagaacuucgccggccccgugagccagcacaacuaccgcccgggguaccacacccagaccgcgggccccuggcaccucgggcggcuggagauggacuucgacuucugcgagggcacgaccguggucgugaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggucacggccggccacgggcagaucgacaacuucagccucggcgugcugggcauggcccuguuccucgaggagaugcugcgcacccggguggggaccaagcacgcgauccugcucgucgccguguccuucgugacccugaucacgggcaacaugagcuuccgcgaccuggggcgcgucauggugauggugggcgccaccaugaccgacgacaucgggaugggcgucaccuaccucgcccugcuggccgcguucaaggugcggcccacguucgccgccggccuccugcugcgcaagcucaccuccaaggagcugaugaugaccaccaucgggaucgugcugcucagccaguccacgauccccgagaccauccuggagcugaccgacgcccucgcccugggcaugauggcgcugaagaucguccggaacauggagaaguaccagcucgccgugaccaucauggccauccugugcgucccgaacgccgugauccugcagaacgccuggaaggugagcugcacgacccucgcggucguguccgugagcccccugcugcucaccuccagccagcagaaggccgacuggaucccccuggcccugaccaucaaggggcucaaccccacggccaucuuccugaccacccugucccgcaccagcaagaagcgguccuggccgcucaacgaggcgaucauggccgucggcauggugagcauccuggccuccagccugcucaagaacgacauccccaugacgggcccccugguggccgggggccugcucaccgucugcuacgugcugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacgcugaccauccucauccggaccggccugcuggucaucagcggccucuucccgguguccauccccaucaccgccgccgcgugguaccugugggaggugaagaagcagcgcgccgggguccugugggacgugcccagcccgccgcccgugggcaaggccgagcucgaggacggggccuaccggaucaagcagaagggcauccugggguacucccagaucggcgccggcgucuacaaggaggggaccuuccacacgauguggcacgugacccgcggcgcggugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagaccaacacgggcaccaucggggccgugagccuggacuucucccccggcaccagcggcucccccaucguggacaagaaggggaaggucgugggccucuacgggaacggcguggucacccggagcggcacguacguguccgcgaucgcccagaccgagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacgcugauccuggccccgacccgcgucguggccgccgagauggaggaggcccuccgcggccugcccauccgguaccagacccccgcgauccgcgccgagcacaccgggcgggagaucguggaccugaugugccacgccacguucaccaugcgccuccugagccccauccgggucccgaacuacaaccugaucaucauggacgaggcccacuucaccgaccccgccuccaucgcggcccgcggcuacaucagcacccggguggagaugggcgaggccgccgggaucuucaugacggccacgccgcccggcucccgcgacccguucccccagagcaacgcgcccaucauggacgaggagcgggagauccccgagcgcuccuggaacagcgggcacgagugggugaccgacuucaagggcaagaccgucugguucgugccguccaucaaggccgggaacgacaucgccgccugccuccggaagaacggcaagaaggugauccagcugagccgcaagacguucgacuccgaguacaucaagacccggaccaacgacugggacuucgucgugaccacggacaucagcgagaugggcgcgaacuucaaggccgagcgcgugaucgacccccggcgcugcaugaagcccgucauccugaccgacggggaggagcgggugauccucgccggccccaugccggugacccacuccagcgccgcccagcgccgggggcgcgucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgggagaagguggacgccaucgacggcgaguaccgccugcgcggggaggcccgcaagacguucguggaccugaugcggcgcggcgaccuccccgucuggcuggccuaccggguggcggccgaggggaucaacuacgccgaccgccgguggugcuucgacggcgucaagaacaaccagauccuggaggagaacguggagguggagaucuggaccaaggagggggagcgcaagaagcucaagccgcgguggcuggacgcccgcaucuacagcgacccccuggcccucaaggaguucaaggaguucgcggccggccggaagucccugacccugaaccucaucaccgagaugggccgccugcccacguucaugacccagaaggcccggaacgcccuggacaaccucgcgguccugcacaccgccgaggccgggggccgcgccuacaaccacgcccugagcgagcuccccgagacccuggagacgcugcuccugcugacccuccuggcgaccgugaccgggggcaucuuccuguuccucauguccggcaaggggaucggcaagaugacccuggggaugugcugcaucaucacggccagcauccugcucugguacgcccagauccagccgcacuggaucgccgccuccaucauccuggaguucuuccugaucgugcuccugauccccgagcccgagaagcagcggacgccccaggacaaccagcugaccuacgucgugaucgcgauccucaccguggucgccgccacgauggccaacgagaugggcuuccuggagaagaccaagaaggacuucgggcugggcagcaucaccacccagcagccggagagcaacauccucgacaucgaccugcgccccgccuccgcguggacgcuguacgccguggccaccaccuucaucacccccaugcuccggcacagcaucgagaacuccagcgugaacgucucccugacggccaucgccaaccaggcgaccgugcugaugggccucgggaagggcuggccccugagcaagauggacaucggggugccgcugcucgccaucggcugcuacucccaggucaaccccaucacccugaccgccgcccugcuccugcugguggcgcacuacgccaucaucgggcccggccuccaggccaaggccacgcgcgaggcccagaagcgggcggccgccggcaucaugaagaaccccaccguggacgggaucaccgucaucgaccuggacccgauccccuacgaccccaaguucgagaagcagcugggccaggugaugcuccuggugcugugcgucacccaggugcucaugaugcgcacgaccugggcccugugcgaggcccugacccucgcgaccgggcccaucagcacgcugugggagggcaacccggggcgcuucuggaacaccaccaucgccguguccauggccaacaucuuccggggcagcuaccuggccggcgccgggcuccuguucuccaucaugaagaacaccgcgaacacgcgccggggcaccgggaacaccggcgagacccugggcgagaaguggaagaaccgccucaacgcccugggcaagagcgaguuccagaucuacaagaaguccggcauccaggaggucgaccggacgcuggccaaggaggggaucaagcgcggcgagaccgaccaccacgccgugagccggggguccgcgaagcuccgcugguucguggagcggaaccuggucacccccgagggcaaggugguggaccugggcugcgggcgcggcggguggagcuacuacugcggcgggcucaagaacgucaaggaggugaagggccugaccaagggcgggcccggccacgaggagcccaucccgauguccacguacggguggaaccuggugcggcuccagagcggcgucgacguguucuucacgccgcccgagaagugcgacacccugcugugcgacaucggggaguccagccccaacccgaccguggaggccggccgcacccuccggguccugaaccugguggagaacuggcucaacaacaacacgcaguucugcaucaaggugcugaaccccuacaugcccagcgucaucgagaagauggaggcccugcagcgcaaguacggcggggcccuggugcggaacccgcucucccgcaacagcacccacgagauguacuggguguccaacgccagcggcaacaucgucuccagcgugaacaugaucucccggaugcugaucaaccgcuucaccaugcggcacaagaaggcgaccuacgagcccgacguggaccuggggagcggcacgcgcaacaucgggaucgaguccgagauccccaaccucgacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggucaacggcguggugcggcugcugaccaagccgugggacgucauccccauggugacccagauggccaugaccgacacgacccccuucgggcagcagcgcguguucaaggagaaggucgacacccggacccaggagcccaaggagggcacgaagaagcucaugaagaucaccgccgaguggcuguggaaggagcugggcaagaagaagaccccgcgcaugugcacccgggaggaguucacgcgcaaggugcgguccaacgcggcccucggggccaucuucaccgacgagaacaaguggaaguccgcccgcgaggccgucgaggacuccggcuucugggagcugguggacaaggagcggaaccugcaccucgaggggaagugcgagaccugcguguacaacaugaugggcaagcgcgagaagaagcugggggaguucggcaaggcgaagggcagccgggccaucugguacauguggcugggggcccgcuuccucgaguucgaggcccugggcuuccugaacgaggaccacugguucucccgggagaacagccucagcggggucgagggcgaggggcugcacaagcugggcuacauccuccgcgacguguccaagaaggagggcggggcgauguacgccgacgacaccgccggcugggacacgcggaucacccuggaggaccugaagaacgaggagauggugaccaaccacauggagggggagcacaagaagcucgccgaggccaucuucaagcugaccuaccagaacaaggucgugcgcgugcagcggcccacgccccgcggcaccgucauggacaucaucagccggcgcgaccagcggggguccggccagguggugaccuacggccugaacaccuucacgaacauggaggcgcagcucauccgccagauggagggggagggcgucuucaagagcauccagcagcugaccgugaccgaggagaucgccgugaagaacuggcugguccgcguggggcgggagcgccucucccggauggccaucagcggcgacgacugcguggucaagccccuggacgaccgcuucgccuccgcccugaccgcgcucaacgacaugggcaaggugcggaaggacauccagcagugggagccgagccgcggguggaacgacuggacccaggugcccuucugcucccaccacuuccacgagcugaucaugaaggacggccggguccugguggugcccugccgcaaccaggacgagcucaucgggcgggcccgcaucagccagggcgccggguggucccugcgggagaccgccugccugggcaagagcuacgcccagauguggucccucauguacuuccaccgccgggaccugcgccuggcggccaacgccaucugcagcgccguccccucccacugggugccgaccagccggaccaccugguccauccacgccacgcacgaguggaugaccaccgaggacaugcucaccguguggaaccgcgucuggauccaggagaaccccuggauggaggacaagacgcccguggagagcugggaggagauccccuaccugggcaagcgggaggaccaguggugcgggagccugaucggccucaccucccgcgcgaccugggccaagaacauccagaccgccaucaaccaggugcggagccugaucgggaacgaggaguacacggacuacaugccguccaugaagcgcuuccgccgggaggaggaggaggccggcguccugugguga

SEQ ID NO: 9711 - RNA, 9876 nt, Artificial Sequence
  derived and/or modified CDS sequence (opt1) from DENV-2__JN851125__SS-prME
accgccgggaucaucaucaugaugauccccaccgugauggccuuccaccugaccacccggaacggggagccgcacaugaucgucagccggcaggagaagggcaagagccuccuguucaagaccgagaacggggugaacaugugcacccugauggcgauggaccucggcgagcugugcgaggacaccaucaccuacaacugcccccugcucaagcagaacgagcccgaggacaucgacugcuggugcaacagcaccagcaccugggugacguacgggaccugcaccgccaccggcgagcaccgccgggagaagcgcagcgucgcccuggugccccacgugggcauggggcuggagacgcggaccgagaccuggaugagcagcgagggcgccuggaagcacgcccagcgcaucgagaccuggguccuccggcacccgggguucacggugauggcggccauccuggccuacaccaucggcaccaccuacuuccagcgcgugcugaucuucauccuccugacggccgucgcgcccuccaugaccaugcggugcaucgggaucagcaaccgcgacuucguggagggcguguccggcgggagcugggucgacaucgugcuggagcacggcuccugcgugaccaccauggccaagaacaagcccacgcucgacuucgagcugaucaagaccgaggccaagcaccccgccacccugcggaaguacugcaucgaggccaagcucaccaacacgaccaccgcgagccgcugcccgacccagggggagcccucccugaacgaggagcaggacaagcgguucgucugcaagcacagcaugguggaccgcggcuggggcaacgggugcggccuguucgggaagggcgggaucgugacgugcgccauguucacgugcaagaagaacauggagggcaaggucgugcagcccgagaaccucgaguacaccaucgugaucacgccccacuccggcgaggagaacgccgucgggaacgacacgggcaagcacgggaaggagaucaaggugaccccgcagagcuccaucaccgaggccgagcugaccggcuacgggaccgugacgauggagugcagcccccggaccggccuggacuucaacgagaugguccuccugcagauggagaacaaggccuggcuggugcaccgccagugguuccucgaccugccccugcccuggcucccgggcgcggacacccagggguccaacuggauccagaaggagacccuggucacguucaagaacccccacgccaagaagcaggacguggugguccugggcagccaggagggggccaugcacaccgcccucaccggcgccaccgagauccagaugagcuccgggaaccugcuguucacgggccaccucaagugccggcugcgcauggacaagcugcagcucaagggcaugagcuacuccaugugcaccgggaaguucaagguggugaaggagaucgcggagacccagcacggcaccaucgucauccgggugcaguacgagggggacggcagccccugcaagauccccuucgagaucauggaccuggagaagcgccacgugcugggccggcucaucacggucaacccgaucgugaccgagaaggacucccccgugaacaucgaggccgagccgcccuucggggacagcuacaucaucaucggcgucgagccggggcagcugaagcuguccugguucaagaagggcagcuccaucgggcagauguucgagaccaccaugcgcggcgccaagcgcauggccauccucggcgacacggccugggacuucgggagccugggcgggguguucaccuccaucggcaaggcgcugcaccagguguucggggccaucuacggcgccgccuucagcggcgucuccuggaccaugaagauccucaucgggguggugaucaccuggaucggcaugaacagccgguccacgagccuguccgucagccuggugcuggugggggucgugacccucuaccugggcgugaugguccaggcggacuccgggugcguggugagcuggaagaacaaggagcugaagugcggcagcggcaucuucaucaccgacaacguccacaccuggacggagcaguacaaguuccagcccgagucccccagcaagcucgccuccgccauccagaaggcccacgaggaggggaucugcggcauccgcagcgugacccggcuggagaaccugauguggaagcagaucacccccgagcucaaccacauccuguccgagaacgaggugaagaugaccaucaugacgggggacaucaagggcaucaugcaggccgggaagcgcagccugcggccgcagcccaccgagcucaaguacuccuggaaggcguggggcaaggccaagaugcugagcaccgagcugcacaaccacaccuuccucaucgacggccccgagacggccgagugcccgaacaccaaccgcgccuggaacucccuggaggucgaggacuacggguucggcguguucaccaccaacaucuggcugaagcucaaggagcggcaggacgugagcugcgacuccaagcugaugagcgccgcgaucaaggacaaccgcgccguccacgccgacaugggguacuggaucgaguccgcccugaacgacacguggaagaucgagaaggccagcuucaucgaggugaaguccugccacuggcccaagagccacacccucugguccaacggcgugcuggagagcgagaugaucauccccaagaacuucgcgggccccgucagccagcacaacuaccggccgggguaccacacccagaccgccggccccuggcaccuggggcgccucgagauggacuucgacuucugcgagggcaccacggugguggucaccgaggacugcgggaaccggggccccucccugcgcaccaccacggccagcggcaagcugaucaccgaguggugcugccgguccugcacccucccgccccugcgcuaccgcggggaggacggcugcugguacgggauggagauccgcccccugaaggagaaggaggagaaccucgugaacagccuggugaccgccggccacgggcagaucgacaacuucucccugggcguccucggcauggcgcuguuccuggaggagaugcuccggacgcgcguggggaccaagcacgccauccugcugguggccgucagcuucgugacccucaucaccggcaacauguccuuccgggaccuggggcgcgugauggucauggugggcgccacgaugaccgacgacaucgggaugggcgugaccuaccuggcccuccuggcggccuucaagguccgccccaccuucgccgccggccugcuccugcggaagcugacgagcaaggagcucaugaugaccaccaucgggaucgugcugcugucccagagcaccauccccgagacgauccucgagcugaccgacgcccuggcgcucggcaugaugguccugaagguggugcgcaacauggagaaguaccagcuggccgucaccaucauggccauccucugcgugcccaacgccgugauccugcagaacgccuggaaggucuccugcaccacgcuggcgguggugagcgucuucccccuccugcugaccuccagccagcagaaggccgacuggaucccccucgcccugaccaucaaggggcugaaccccaccgccaucuuccucacgacccugucccggaccagcaagaagcgcuccuggccgcugaacgaggcgaucauggccgugggcauggugagcauccucgccuccagccugcugaagaacgacauccccaugaccggcccccucgucgccgggggccugcugacggugugcuacgugcucaccgggcggagcgccgaccuggagcuggagcgcgcggccgacguccggugggaggagcaggccgagaucuccggcagcucccccauccucagcaucaccaucuccgaggacgggagcauguccaucaagaacgaggaggaggagcagacccugacgauccugauccgcaccggccuccuggugaucagcggccuguucccgguguccauccccaucaccgccgccgcgugguaccucugggaggucaagaagcagcgggccggggugcugugggacgugcccuccccgccgcccgucggcaaggccgagcuggaggacggggccuaccgcaucaagcagaagggcauccucggguacucccagaucggcgccggcguguacaaggaggggaccuuccacaccauguggcacgugacgcggggcgcgguccugaugcacaaggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggccgugcagaccaagcccggccucuucaagaccaacaccggcacgaucggggccgugagccuggacuucucccccggcaccagcggcucccccaucgucgacaagaaggggaagguggugggccuguacgggaacggcgucgugacccgcagcggcaccuacguguccgcgaucgcccagacggagaaguccaucgaggacaaccccgagaucgaggacgacaucuuccggaagaagcgccucaccaucauggaccugcaccccggggccggcaagaccaagcgguaccugcccgccaucguccgcgaggcgaucaagcgggggcugcgcacccucauccuggccccgacgcgggugguggccgccgagauggaggaggcccugcgcggccuccccauccgcuaccagacccccgcgauccgggccgagcacaccgggcgcgagaucgucgaccugaugugccacgccaccuucacgaugcggcugcucagccccauccgcgugccgaacuacaaccugaucaucauggacgaggcccacuucaccgaccccgccuccaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucaccgacuucaagggcaagaccgugugguucgugccguccaucaaggccgggaacgacaucgccgccugccugcgcaagaacggcaagaaggucauccagcucagccggaagaccuucgacuccgaguacaucaagacgcgcaccaacgacugggacuucguggugaccaccgacaucagcgagaugggcgcgaacuucaaggccgagcgggucaucgacccccgccggugcaugaagcccgugauccugacggacggggaggagcgcgugauccuggccggccccaugccggucacccacuccagcgccgcccagcggcgcgggcgggugggccgcaaccccaagaacgaguccgaccaguacaucuacaugggggagccccucgagaacgacgaggacugcgcgcacuggaaggaggccaagaugcugcuggacaacaucaacacccccgagggcaucaucccgagcauguucgagcccgagcgcgagaaggucgacgccaucgacggcgaguaccggcuccgcggggaggcccggaagaccuucguggaccugaugcgccggggcgaccugcccguguggcucgccuaccgcgucgcggccgaggggaucaacuacgccgaccggcgcuggugcuucgacggcgugaagaacaaccagauccuggaggagaacguggaggucgagaucuggacgaaggagggggagcggaagaagcugaagccgcgcuggcucgacgcccggaucuacuccgacccccuggcccugaaggaguucaaggaguucgcggccggccgcaagagccucacccugaaccugaucaccgagaugggccggcuccccaccuucaugacgcagaaggcccgcaacgcccuggacaaccuggcggugcuccacaccgccgaggccgggggccgggccuacaaccacgcccuguccgagcugcccgagacccucgagacccugcugcuccugacgcugcucgcgaccgugaccgggggcaucuuccuguuccugaugagcggcaaggggaucggcaagaugacccucgggaugugcugcaucaucaccgccuccauccugcugugguacgcccagauccagccgcacuggaucgccgccagcaucauccucgaguucuuccugaucguccugcucauccccgagcccgagaagcagcgcacgccccaggacaaccagcugaccuacguggugaucgcgauccugaccgucguggccgccaccauggccaacgagaugggcuuccucgagaagacgaagaaggacuucgggcugggcagcuccaccacccagcagcacgagagcaacauccuggacaucgaccuccggccggccuccgcguggacccuguacgccguggccacgaccuucaucacccccaugcugcgccacagcaucgagaacuccagcgucaacgugucccucaccgccaucgccaaccaggcgacggugcugaugggccuggggaagggcuggccccucagcaagauggacaucggggucccccugcuggccaucggcugcuacucccaggugaacccgaucacccucaccgccgcccugcugagccucguggcgcacuacgccaucaucgggcccggccugcaggccaaggccacccgggaggcccagaagcgcgcggccgccggcaucaugaagaaccccacggucgacgggaucaccgugaucgaccuggaccccaucccguacgaccccaaguucgagaagcagcucggccaggugaugcugcugguccucugcgugacccaggugcugaugaugcggaccacgugggcccugugcgaggcccucacccuggcgaccgggcccaucuccacccugugggagggcaaccccgggcgcuucuggaacacgaccaucgccgucagcauggccaacaucuuccgcggcuccuaccucgccggcgccgggcugcuguucagcaucaugaagaacaccgcgaacacccggcgcggcacggggaacaccggcgagacccucggcgagaaguggaagaaccggcugaacgcccuggggaaguccgaguuccagaucuacaagaaguccggcauccaggagguggaccgcacccucgccaaggaggggaucaagcggggcgagacggaccaccacgccgugucccgcgggagcgcgaagcugcggugguucgucgagcgcaaccuggugaccccggagggcaagguggucgaccucggcugcgggcggggcgggugguccuacuacugcggcgggcugaagaacgugaaggaggugaagggccugaccaagggcgggcccggccacgaggagcccauccccaugagcaccuacggguggaaccucguccgccugcagagcggcguggacguguucuucacgccgcccgagaagugcgacacccugcucugcgacaucggggaguccagccccaaccccaccgucgaggccggccggacccugcgcgugcugaaccucguggagaacuggcugaacaacaacacccaguucugcaucaagguccugaacccguacaugcccuccgugaucgagaagauggaggcccuccagcggaaguacggcggggcccuggugcgcaacccccugagccggaacuccacgcacgagauguacugggucagcaacgccuccggcaacaucgugagcuccgugaacaugaucagccgcaugcugaucaaccgguucaccaugcgccacaagaaggcgaccuacgagccggacgucgaccucggguccggcacccggaacaucgggaucgagagcgagacgcccaaccuggacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgugguccgccugcucaccaagcccugggacgugaucccgauggucacccagauggccaugaccgacacgacccccuucgggcagcagcggguguucaaggagaagguggacacccgcacccaggagcccaaggagggcacgaagaagcugaugaagaucaccgccgaguggcuguggaaggagcucggcaagaagaagacgccccggaugugcacccgcgaggaguucacgcggaagguccgcagcaacgcggcccugggggccaucuucaccgacgagaacaaguggaaguccgcccgggaggccguggaggacagcggcuucugggagcugguggacaaggagcgcaaccuccaccuggaggggaagugcgagaccugcgucuacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgagaacagccuguccgggguggagggcgaggggcugcacaagcucggcuacauccugcgggacgugagcaagaaggagggcggggcgauguacgccgacgacaccgccggcugggacacgcgcaucacccuggaggaccucaagaacgaggagauggucaccaaccacauggagggggagcacaagaagcuggccgaggccaucuucaagcugaccuaccagaacaagguggugcggguccagcgcccgacgccccggggcaccgugauggacaucaucucccgccgggaccagcgcgggagcggccagguggucaccuacggccucaacaccuucacgaacauggaggcgcagcugauccggcagauggagggggagggcguguucaaguccauccagcagcugaccgccaccgaggagaucgccgugaagaacuggcucguccgcguggggcgcgagcggcugagccgcauggccaucuccggcgacgacugcguggucaagccccuggacgaccgguucgccagcgcgcucaccgcccugaacgacaugggcaaggugcgcaaggacauccagcagugggagcccucccggggguggaacgacuggacccaggugccguucugcagccaccacuuccacgagcugaucaugaaggacggccgcguccucguggugcccugccggaaccaggacgagcugaucgggcgcgcccggaucucccagggcgccggguggagccugcgcgagaccgccugccucggcaaguccuacgcgcagauguggagccugauguacuuccaccggcgcgaccugcggcucgccgccaacgccaucugcuccgccguccccagccacugggugcccaccagccgcaccaccugguccauccacgcgacgcacgaguggaugaccaccgaggacaugcugaccguguggaaccgggucuggauccaggagaacccguggauggaggacaagacgcccguggagagcugggaggagauccccuaccugggcaagcgcgaggaccaguggugcgggucccucaucggccugaccagccgggccaccugggccaagaacauccagaccgccaucaaccaggugcgcucccugaucgggaacgaggaguacacggacuacaugcccagcaugaagcgguuccgccgcgaggaggaggaggcgggcguccucugguga

SEQ ID NO: 9712 - RNA, 9876 nt, Artificial Sequence
  derived and/or modified CDS sequence (opt1) from DENV-2__JN851123__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacacgaucaccuacaacugcccccugcucaagcagaacgagcccgaggacaucgacugcuggugcaacagcaccagcaccugggugacguacgggaccugcaccgccaccggcgagcaccgccgggagaagcgcagcgucgcccuggugccccacgugggcauggggcuggagacgcggaccgagaccuggauguccagcgagggcgccuggaagcacgcccagcgcaucgagaccuggguccuccggcaccccggguucacgaucauggcggccauccuggccuacaccaucggcaccaccuacuuccagcgcgugcugaucuucauccuccugacggccguggcgcccuccaugaccaugcggugcaucgggaucagcaaccgcgacuucgucgagggcguguccggcgggagcuggguggacaucguccuggagcacggcuccugcgugaccaccauggccaagaacaagcccacgcucgacuucgagcugaucaagaccgaggccaagcaccccgccacccugcggaaguacugcaucgaggccaagcucaccaacacgaccaccgcgagccgcugcccgacccagggggagcccucccugaacgaggagcaggacaagcgguucgugugcaagcacagcauggucgaccgcggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccggaccggccuggacuucaacgagauggugcuccugcagauggagaacaaggccuggcuggugcaccgccagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccggcugcgcauggacaagcugcagcucaagggcaugagcuacuccaugugcaccgggaaguucaagguggucaaggagaucgcggagacccagcacggcaccaucgugauccgggugcaguacgagggggacggcagccccugcaagauccccuucgagaucauggaccuggagaagcgccacguccugggccggcucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcgcauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgguccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccgcagcgugacccggcuggagaaccugauguggaagcagaucacccccgagcucaaccacauccuguccgagaacgagaucaagcugaccaucaugacgggggacaucaagggcaucaugcaggccgggaagcgcagccuccggccgcagcccaccgagcugaaguacuccuggaaggcguggggcaaggccaagaugcugagcaccgagcuccacaaccacaccuuccugaucgacggccccgagacggccgagugcccgaacaccaaccgcgccuggaacucccuggaggucgaggacuacggguucggcguguucaccaccaacaucuggcucaagcugaaggagcggcaggacguguucugcgacagcaagcugauguccgccgcgaucaaggacaaccgcgccguccacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccggccgggguaccacacccagaccgccggccccuggcaccucgggcgccuggagauggacuucgacuucugcgagggcaccacggugguggucaccgaggacugcgggaaccggggccccagccugcgcaccaccacggccuccggcaagcucaucaccgaguggugcugccggagcugcacccugcccccgcugcgcuaccgcggggaggacggcugcugguacgggauggagauccgcccccucaaggagaaggaggagaaccuggugaacucccuggugaccgccggccacgggcagaucgacaacuucagccucggcguccugggcauggcgcuguuccucgaggagaugcugcggacgcgcguggggaccaagcacgccauccugcucguggccgucuccuucgugacccugaucaccggcaacaugagcuuccgggaccuggggcgcgugauggucauggugggcgccacgaugaccgacgacaucgggaugggcgugaccuaccucgcccugcuggcggccuucaagguccgccccaccuucgccgccggccuccugcugcggaagcucacguccaaggagcugaugaugaccaccaucgggaucgugcugcucagccaguccaccauccccgagacgauccuggagcugaccgacgcccucgcgcugggcaugauggugcugaagaucguccgcaacauggagaaguaccagcucgccgugaccaucauggccauccugugcgucccgaacgccgugauccugcagaacgccuggaaggugagcugcaccacgcucgcggucguguccgugagcccccugcugcucaccuccagccagcagaaggccgacuggaucccccuggcccugaccaucaaggggcucaaccccaccgccaucuuccugacgacccugucccggaccagcaagaagcgcuccuggccgcucaacgaggcgaucauggccgucggcauggugagcauccuggccuccagccugcucaagaacgacauccccaugaccggcccccugguggccgggggccugcucacggucugcuacgugcugaccgggcggagcgccgaccuggagcucgagcgcgcggccgacgugcggugggaggagcaggccgagaucuccggcagcucccccauccugagcaucaccaucuccgaggacgggagcauguccaucaagaacgaggaggaggagcagacccugacgauccucauccgcaccggccugcuggucaucagcggccucuucccgguguccauccccaucaccgccgccgcgugguaccugugggaggugaagaagcagcgggccgggguccugugggacgugcccagcccgccgcccgugggcaaggccgagcucgaggacggggccuaccgcaucaagcagaagggcauccugggguacucccagaucggcgccggcgucuacaaggaggggaccuuccacaccauguggcacgugacgcggggcgcggugcugaugcacaaggggaagcgcaucgagcccagcugggccgacgucaagaaggaccucaucuccuacggcgggggcuggaagcuggagggcgaguggaaggagggggaggagguccaggugcuggcccucgagcccggcaagaacccccgggccguccagaccaagcccgggcuguucaagaccaacaccggcacgaucggggccgugagccuggacuucucccccggcaccagcggcucccccaucguggacaagaaggggaaggucgugggccucuacgggaacggcguggucacccgcagcggcaccuacguguccgcgaucgcccagacggagaaguccaucgaggacaaccccgagaucgaggacgacaucuuccggaagaagcgccugaccaucauggaccugcaccccggggccggcaagaccaagcgguaccugcccgccaucgugcgcgaggcgaucaagcgggggcuccgcacccugauccuggccccgacgcgggucguggccgccgagauggaggaggcccuccgcggccugcccauccgcuaccagacccccgcgauccgggccgagcacaccgggcgcgagaucguggaccugaugugccacgccaccuucacgaugcggcuccugagccccauccgcgucccgaacuacaaccugaucaucauggacgaggcccacuucaccgaccccgccuccaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggugaccgacuucaagggcaagaccgucugguucgugccguccaucaaggccgggaacgacaucgccgccugccuccgcaagaacggcaagaaggugauccagcugagccggaagaccuucgacuccgaguacaucaagacgcgcaccaacgacugggacuucgucgugaccaccgacaucagcgagaugggcgcgaacuucaaggccgagcgggugaucgacccccgccggugcaugaagcccgucauccugacggacggggaggagcgcgugauccucgccggccccaugccggugacccacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucguggaccugaugcgccggggcgaccuccccgucuggcuggccuaccgcguggcggccgaggggaucaacuacgccgaccggcgcuggugcuucgacggcgucaagaacaaccagauccuggaggagaacguggagguggagaucuggacgaaggagggggagcggaagaagcucaagccgcgcuggcuggacgcccggaucuacagcgacccccuggcccucaaggaguucaaggaguucgcggccggccgcaagucccugacccugaaccucaucaccgagaugggccggcugcccaccuucaugacgcagaaggcccgcaacgcccuggacaaccucgcgguccugcacaccgccgaggccgggggccgggccuacaaccacgcccugagcgagcuccccgagacccuggagacccugcuccugcugacgcuccuggcgaccgugaccgggggcaucuuccuguuccucauguccggcaaggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugaccuacgucgugaucgcgauccucaccguggucgccgccaccauggccaacgagaugggcuuccuggagaagacgaagaaggacuucgggcugggcagcaucaccacccagcagccggagagcaacauccucgacaucgaccugcggcccgccuccgcguggacccuguacgccguggccacgaccuucaucacccccaugcuccgccacagcaucgagaacuccagcgugaacgucucccugaccgccaucgccaaccaggcgacggugcugaugggccucgggaagggcuggccccugagcaagauggacaucggggugccgcugcucgccaucggcugcuacucccaggucaaccccaucacccugaccgccgcccugcuccugcugguggcgcacuacgccaucaucgggcccggccuccaggccaaggccacccgggaggcccagaagcgcgcggccgccggcaucaugaagaaccccacgguggacgggaucaccgucaucgaccuggacccgauccccuacgaccccaaguucgagaagcagcugggccaggugaugcuccuggugcugugcgucacccaggugcucaugaugcggaccacgugggcccugugcgaggcccugacccucgcgaccgggcccaucagcacccugugggagggcaacccggggcgcuucuggaacacgaccaucgccguguccauggccaacaucuuccgcggcagcuaccuggccggcgccgggcuccuguucuccaucaugaagaacaccgcgaacacccggcgcggcacggggaacaccggcgagacccugggcgagaaguggaagaaccggcucaacgcccugggcaagagcgaguuccagaucuacaagaaguccggcauccaggaggucgaccgcacccuggccaaggaggggaucaagcggggcgagacggaccaccacgccgugagccgcggguccgcgaagcuccggugguucaucgagcgcaaccuggugacccccgagggcaaggucguggaccugggcugcgggcggggcggguggagcuacuacugcggcgggcucaagaacgugaaggaggucaagggccugaccaagggcgggcccggccacgaggagcccaucccgauguccaccuacggguggaaccuggugcgccuccagagcggcguggacgucuucuucacgccgcccgagaagugcgacacccugcugugcgacaucggggaguccagccccaacccgaccguggaggccggccggacccuccgcgugcugaaccuggucgagaacuggcucaacaacaacacccaguucugcaucaaggugcugaaccccuacaugcccagcgugaucgagaagauggaggcccugcagcggaaguacggcggggcccugguccgcaacccgcucucccggaacagcacgcacgagauguacuggguguccaacgccagcggcaacaucguguccagcgucaacaugaucucccgcaugcugaucaaccgguucaccaugcgccacaagaaggcgaccuacgagcccgacguggaccuggggagcggcacccggaacaucgggaucgaguccgagacgcccaaccucgacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcugaccaagccgugggacgugauccccauggucacccagauggccaugaccgacacgacccccuucgggcagcagcggguguucaaggagaagguggacacccgcacccaggagcccaaggagggcacgaagaagcucaugaagaucaccgccgaguggcuguggaaggagcugggcaagaagaagaccccgcggaugugcacccgcgaggaguucacgcggaagguccgcuccaacgcggcccucggggccaucuucaccgacgagaacaaguggaaguccgcccgggaggccguggaggacuccggcuucugggagcuggucgacaaggagcgcaaccugcaccucgaggggaagugcgagaccugcguguacaacaugaugggcaagcgggagaagaagcugggggaguucggcaaggcgaagggcagccgcgccaucugguacauguggcugggggcccgguuccucgaguucgaggcccugggcuuccugaacgaggaccacugguucucccgcgagaacagccucagcgggguggagggcgaggggcugcacaagcugggcuacauccuccgggacgucuccaagaaggagggcggggcgauguacgccgacgacaccgccggcugggacacgcgcaucacccuggaggaccugaagaacgaggagauggugaccaaccacauggagggggagcacaagaagcucgccgaggccaucuuccggcugaccuaccagaacaaggugguccgcgugcagcggcccacgccccgcggcaccgugauggacaucaucagccggcgcgaccagcggggguccggccaggucgugaccuacggccugaacaccuucacgaacauggaggcgcagcucauccgccagauggagggggagggcguguucaagagcauccagcaccugaccgucaccgaggagaucgccgugaagaacuggcuggugcgcgucgggcgggagcgccucucccggauggccaucagcggcgacgacugcguggugaagccccuggacgaccgcuucgccuccgcccugaccgcgcucaacgacaugggcaagguccggaaggacauccagcagugggagccgagccgcggguggaacgacuggacccaggugcccuucugcucccaccacuuccacgagcugaucaugaaggacggccgggugcuggucgugcccugccgcaaccaggacgagcucaucgggcgggcccgcaucagccagggcgccggguggucccugcgggagaccgccugccugggcaagagcuacgcccagauguggucccucauguacuuccaccgccgggaccugcgccuggcggccaacgccaucugcagcgccgugcccucccacugggucccgaccagccggaccaccugguccauccacgccacgcacgaguggaugaccaccgaggacaugcucaccguguggaaccgcguguggauccaggagaaccccuggauggaggacaagacgcccaucgagagcugggaggagauccccuaccugggcaagcgggaggaccaguggugcgggagccugaucggccucaccucccgcgcgaccugggccaagaacauccagaccgccaucaaccagguccggagccugaucgggaacgaggaguacacggacuacaugccguccaugaagcgcuuccgccgggaggaggaggaggccggcgugcugugguga

SEQ ID NO: 9713 - RNA, 9876 nt, Artificial Sequence
  derived and/or modified CDS sequence (opt1) from DENV-2__JN851118__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgugauggugcaggcggacuccgggugcgucgugagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgucacccgccuggagaaccugauguggaagcagaucacccccgagcucaaccacauccugaccgagaacgaggugaagcugacgaucaugaccggggacaucaagggcaucaugcaggccgggaagcggucccuccgcccgcagcccaccgagcugaaguacagcuggaaggcguggggcaaggccaagaugcuguccaccgagcuccacaaccacacguuccugaucgacggccccgagaccgccgagugcccgaacaccaaccgggccuggaacagccuggagguggaggacuacggguucggcgucuucaccacgaacaucuggcucaagcugaaggagcgccaggacguguucugcgacuccaagcugaugagcgccgcgaucaaggacaaccgggccgugcacgccgacaugggguacuggaucgaguccgcccucaacgacaccuggaagaucgagaaggccagcuucaucgaggucaaguccugccacuggcccaagagccacacccugugguccaacggcgugcuggagagcgagaugaucauccccaagaacuucgcgggccccgugucccagcacaacuaccgcccgggguaccacacccagaccgccggccccuggcaccucgggcggcuggagauggacuucgacuucugcgagggcacgaccgucguggugaccgaggacugcgggaaccgcggccccagccugcggaccacgaccgccagcggcaagcucaucaccgaguggugcugccgcuccugcacccugcccccgcugcgguaccgcggggaggacggcugcugguacgggauggagauccggccccucaaggagaaggaggagaaccuggucaacagccuggugacggccggccacgggcagaucgacaacuucucccucggcgugcugggcauggcgcuguuccucgaggagaugcugcgcacccgggucgggaccaagcacgccauccugcucguggccgugagcuucgucacccugaucacgggcaacauguccuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccagcaaggagcugaugaugaccaccaucgggaucguccugcucucccagagcacgauccccgaguccauccuggagcugaccgacgcccucgcgcugggcaugauggugcugaagaucguccggaacauggagaaguaccagcucgccgugaccaucauggccauccugugcgugccgaacgccgucauccugcagaacgccuggaaggugagcugcaccacgcucgcgguggucuccgugagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgugggcauggucagcauccuggccuccagccugcucaagaacgacauccccaugaccggcccccugguggccgggggccugcucacggugugcuacguccugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccggucuccauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacucccagaucggcgccggcguguacaaggaggggaccuuccacaccauguggcacgucacgcgcggcgcggugcugaugcacaaggggaagcggaucgagcccagcugggccgacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagaccaacaccggcacgaucggggccgucagccuggacuucucccccggcaccagcggcucccccaucguggacaagaaggggaagguggucggccucuacgggaacggcguggugacccggagcggcaccuacgucuccgcgaucgcccagacggagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcguggucgccgccgagauggaggaggcccuccgcggccugcccauccgguaccagacccccgcgauccgcgccgagcacaccgggcgggagaucguggaccugaugugccacgccaccuucacgaugcgccuccugagccccauccgggugccgaacuacaaccugaucaucauggacgaggcccacuucaccgaccccgccuccaucgcggcccgcggcuacaucagcacccgggucgagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugaccgacuucaagggcaagaccgugugguucgucccguccaucaaggccgggaacgacaucgccgccugccuccggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccccggcgcugcaugaagcccgugauccugacggacggggaggagcgggucauccucgccggccccaugccggugacccacuccagcgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgggagaaggucgacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgugaagaacaaccagauccuggaggagaacgucgagguggagaucuggacgaaggagggggagcgcaagaagcucaagccgcgguggcuggacgcccgcaucuacagcgacccccuggcccucaaggaguucaaggaguucgcggccggccggaagucccugacccugaaccucaucaccgagaugggccgccugcccaccuucaugacgcagaaggccaagaacgcccuggacaaccucgcggugcugcacaccgccgaggccgggggccgggccuacaaccacgcccugagcgagcuccccgagacccuggagacccugcuccugcugacgcuccuggcgaccgucaccgggggcaucuuccuguuccucauguccggcaaggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugaccuacguggucaucgcgauccucaccgugguggccgccaccauggccaacgagaugggcuuccuggagaagacgaagaaggacuucgggcugggcagcaucaccacccagcagccggagagcaacauccucgacaucgaccugcggcccgccuccgcguggacccuguacgccgucgccacgaccuucaucacccccaugcuccgccacagcaucgagaacuccagcgugaacgugucccugaccgccaucgccaaccaggcgacgguccugaugggccucgggaagggcuggccccugagcaagauggacaucggggugccgcugcucgccaucggcugcuacucccaggugaaccccaucacccugaccgccgcccugcuccugcuggucgcgcacuacgccaucaucgggcccggccuccaggccaaggccacccgggaggcccagaagcgcgcggccgccggcaucaugaagaaccccacgguggacgggaugaccgugaucgaccuggacccgauccccuacgaccccaaguucgagaagcagcugggccaggucaugcuccuggugcugugcgugacccagguccucaugaugcggaccacgugggcccugugcgaggcccugacccucgcgaccgggcccaucagcacccugugggagggcaacccggggcgcuucuggaacacgaccaucgccguguccauggccaacaucuuccgcggcagcuaccuggccggcgccgggcuccuguucuccaucaugaagaacaccgcgaacacccggcgcggcacggggaacaccggcgagacccugggcgagaaguggaagaaccggcucaacgcccugggcaagagcgaguuccagaucuacaagaaguccggcauccaggagguggaccgcacccuggccaaggaggggaucaagcggggcgagacggaccaccacgccgucagccgcggguccgcgaagcuccggugguucguggagcgcaaccuggugacccccgagggcaaggucguggaccugggcugcgggcggggcggguggagcuacuacugcggcgggcucaagaacgugaaggaggucaagggccugaccaagggcgggcccggccacgaggagcccaucccgauguccaccuacggguggaaccuggugcgccuccagagcggcguggacgucuucuucacgccgcccgagaagugcgacacccugcugugcgacaucggggaguccagccccaacccgaccguggaggccggccggacccuccgcgugcugaaccuggucgagaacuggcucaacaacaacacccaguucugcaucaaggugcugaaccccuacaugcccagcgugaucgagaagauggaggcccugcagcggaaguacggcggggcccugguccgcaacccgcucucccggaacagcacgcacgagauguacuggguguccaacgccagcggcaacaucguguccagcgucaacaugaucucccgcaugcugaucaaccgguucaccaugcgccacaagaaggcgaccuacgagcccgacguggaccuggggagcggcacccggaacaucgggaucgaguccgagacgcccaaccucgacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcgccugcugaccaagccgugggacgugauccccauggucacccagauggccaugaccgacacgacccccuucgggcagcagcggguguucaaggagaaggucgacacccgcacccaggagcccaaggagggcacgaagaagcucaugaagaucaccgccgaguggcuguggaaggagcugggcaagaagaagaccccgcggaugugcacccgcgaggaguucacgcggaaggugcgcuccaacgcggcccucggggccaucuucaccgacgagaacaaguggaaguccgcccgggaggccguggaggacuccggcuucugggagcuggucgacaaggagcgcaaccugcaccucgaggggaagugcgagaccugcguguacaacaugaugggcaagcgggagaagaagcugggggaguucggcaaggcgaagggcagccgcgccaucugguacauguggcugggggcccgguuccucgaguucgaggcccugggcuuccugaacgaggaccacugguucucccgcgagaacagccucagcgggguggagggcgaggggcugcacaagcugggcuacauccuccgggacgucuccaagaaggagggcggggcgauguacgccgacgacaccgccggcugggacacgcgcaucacccuggaggaccugaagaacgaggagauggugaccaaccacauggagggggagcacaagaagcucgccgaggccaucuucaagcugaccuaccagaacaaggugguccgggugcagcgccccacgccccggggcaccgugauggacaucaucagccgccgggaccagcgcggguccggccaggucgugaccuacggccugaacaccuucacgaacauggaggcgcagcucauccggcagauggagggggagggcguguucaagagcauccagcagcugaccgucaaggaggagaucgccgugaagaacuggcugauccgcguggggcgcgagcggcucucccgcauggccaucagcggcgacgacugcgucgugaagccccuggacgaccgguucgccuccgcccugaccgcgcucaacgacaugggcaaggugcgcaaggacauccagcagugggagccgagccggggguggaacgacuggacccagguccccuucugcucccaccacuuccacgagcugaucaugaaggacggccgcgugcuggugguccccugccggaaccaggacgagcucaucgggcgcgcccggaucagccagggcgccggguggucccugcgcgagacggccugccugggcaagagcuacgcccagauguggucccucauguacuuccaccggcgcgaccugcggcuggcggccaacgccaucugcagcgccgugcccucccacuggaucccgaccagccgcaccaccugguccauccacgccacccacgaguggaugacgaccgaggacaugcucaccguguggaaccgggucuggauccaggagaaccccuggauggaggacaagacccccguggagagcugggaggagauccccuaccugggcaagcgcgaggaccaguggugcgggagccugaucggccucacgucccgggcgaccugggccaagaacauccagaccgccaucaaccaggugcgcagccugaucgggaacgaggaguacaccgacuacaugccguccaugaagcgguuccgccgcgaggaggaggaggccggcguccugugguga

SEQ ID NO: 9714 - RNA, 9876 nt, Artificial Sequence
  derived and/or modified CDS sequence (opt1) from DENV-2__JN851124__SS-prME
accgcgggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcucaagcagaacgagcccgaggacaucgacugcuggugcaacagcaccuccaccugggugaccuacgggaccugcaccgccaccggcgagcaccgccgggagaagcgcagcgucgcccuggugccccacgugggcauggggcuggagacgcggaccgagaccuggauguccagcgagggcgccuggaagcacgcccagcgcaucgagaccugggucaugcggcacccgggguucacggugauggcggccauccucgccuacaccaucggcaccaccuacuuccagcgcgugcugaucuucauccugcucacggccgucgcgcccuccaugaccaugcggugcaucgggaucagcaaccgcgacuucguggagggcguguccggcgggagcugggucgacaucgugcuggagcacggcuccugcgugaccaccauggccaagaacaagcccacgcuggacuucgagcucaucaagaccgaggccaagcaccccgccacccugcggaaguacugcaucgaggccaagcugaccaacacgaccaccgcgagccgcugcccgacccagggggagcccucccucaacgaggagcaggacaagcgguucgucugcaagcacagcaugguggaccgcggcuggggcaacgggugcggccuguucgggaagggcgggaucgugacgugcgccauguucacgugcaagaagaacauggagggcaaggucgugcagcccgagaaccuggaguacaccaucgugaucacgccccacuccggcgaggagaacgccgucgggaacgacacgggcaagcacgggaaggagaucaaggugaccccgcagagcuccaucaccgaggccgagcucaccggcuacgggaccgugacgauggagugcagcccccggaccggccuggacuucaacgagaugguccugcuccagauggagaacaaggccuggcuggugcaccgccagugguuccuggaccucccccugcccuggcugccgggcgcggacacccagggguccaacuggauccagaaggagacccucgucacguucaagaacccccacgccaagaagcaggacguggugguccugggcagccaggagggggccaugcacaccgcccugaccggcgccaccgagauccagaugagcuccgggaaccuccuguucacgggccaccugaagugccggcuccgcauggacaagcugcagcugaagggcaugagcuacuccaugugcaccgggaaguucaagguggugaaggagaucgcggagacccagcacggcaccaucgucauccgggugcaguacgagggggacggcagccccugcaagauccccuucgagaucauggaccucgagaagcgccacgugcugggccggcugaucacggucaacccgaucgugaccgagaaggacucccccgugaacaucgaggccgagccgcccuucggggacagcuacaucaucaucggcgucgagccggggcagcucaagcuguccugguucaagaagggcagcuccaucgggcagauguucgagaccaccaugcgcggcgccaagcgcauggccauccugggcgacacggccugggacuucgggagccucggcgggguguucaccuccaucggcaaggcgcugcaccagguguucggggccaucuacggcgccgccuucagcggcgucuccuggaccaugaagauccugaucgggguggugaucaccuggaucggcaugaacagccgguccacgagccucuccgucagccuggugcuggugggggucgugacccuguaccucggcgugaugguccaggcggacuccgggugcguggugagcuggaagaacaaggagcugaagugcggcagcggcaucuucaucaccgacaacguccacaccuggacggagcaguacaaguuccagcccgagucccccagcaagcuggccuccgccauccagaaggcccacgaggaggggaucugcggcauccgcagcgugacccggcucgagaaccugauguggaagcagaucacccccgagcugaaccacauccucuccgagaacgaggugaagaugaccaucaugacgggggacaucaagggcaucaugcaggccgggaagcgcagccugcggccgcagcccaccgagcugaaguacuccuggaaggcguggggcaaggccaagaugcucagcaccgagcugcacaaccacaccuuccugaucgacggccccgagacggccgagugcccgaacaccaaccgcgccuggaacucccucgaggucgaggacuacggguucggcguguucaccaccaacaucuggcugaagcugaaggagcggcaggacgugagcugcgacuccaagcucaugagcgccgcgaucaaggacaaccgcgccguccacgccgacaugggguacuggaucgaguccgcccugaacgacacguggaagaucgagaaggccagcuucaucgaggugaaguccugccacuggcccaagagccacacccugugguccaacggcgugcucgagagcgagaugaucauccccaagaacuucgcgggccccgucagccagcacaacuaccggccgggguaccacacccagaccgccggccccuggcaccuggggcgccuggagauggacuucgacuucugcgagggcaccacggugguggucaccgaggacugcgggaaccggggccccucccuccgcaccaccacggccagcggcaagcugaucaccgaguggugcugccgguccugcacccugcccccgcuccgcuaccgcggggaggacggcugcugguacgggauggagauccgcccccugaaggagaaggaggagaaccuggugaacagccucgugaccgccggccacgggcagaucgacaacuucucccugggcguccugggcauggcccucuuccuggaggagaugcugcggacgcgcguggggaccaagcacgccauccuccugguggccgucagcuucgugacccugaucaccggcaacauguccuuccgggaccucgggcgcgugauggucauggugggcgccacgaugaccgacgacaucgggaugggcgugaccuaccuggcccugcucgcggccuucaagguccgccccaccuucgccgccggccugcugcuccggaagcugacgagcaaggagcugaugaugaccaccaucgggaucgugcuccugucccagagcaccauccccgagacgauccuggagcucaccgacgcccuggcgcugggcaugaugguccucaagguggugcgcaacauggagaaguaccagcuggccgucaccaucauggccauccugugcgugccgaacgccgugauccuccagaacgccuggaaggucuccugcaccacgcuggcgguggugagcgucagcccccugcuccugaccagcucccagcagaaggccgacuggaucccccuggcccucaccaucaaggggcugaaccccaccgccaucuuccugacgacccucagccggaccuccaagaagcgcagcuggccgcugaacgaggcgaucauggccgugggcaugguguccauccuggccagcagccuccugaagaacgacauccccaugaccggcccccuggucgccgggggccuccugacggugugcuacgugcugaccgggcgguccgccgaccucgagcuggagcgcgcggccgacguccggugggaggagcaggccgagaucagcggcuccagccccauccuguccaucaccaucagcgaggacggguccaugagcaucaagaacgaggaggaggagcagacccucacgauccugauccgcaccggccugcucgugaucuccggccuguucccggugagcauccccaucaccgccgccgcgugguaccugugggaggucaagaagcagcgggccggggugcucugggacgugcccagcccgccgcccgucggcaaggccgagcuggaggacggggccuaccgcaucaagcagaagggcauccugggguacagccagaucggcgccggcguguacaaggaggggaccuuccacaccauguggcacgugacgcggggcgcgguccucaugcacaaggggaagcgcaucgagcccuccugggccgacgugaagaaggaccugaucagcuacggcgggggcuggaagcuggagggcgaguggaaggagggggaggaggugcagguccucgcccuggagcccggcaagaacccccgggccgugcagaccaagcccgggcuguucaagaccaacaccggcacgaucggggccgugucccucgacuucagccccggcaccuccggcagccccaucgucgacaagaaggggaagguggugggccuguacgggaacggcgucgugacccgcuccggcaccuacgugagcgcgaucgcccagacggagaaguccaucgaggacaaccccgagaucgaggacgacaucuuccggaagaagcgccugaccaucauggaccuccaccccggggccggcaagaccaagcgguaccugcccgccaucguccgcgaggcgaucaagcgggggcugcgcacccugauccucgccccgacgcgggugguggccgccgagauggaggaggcccugcgcggccugcccauccgcuaccagacccccgcgauccgggccgagcacaccgggcgcgagaucgucgaccucaugugccacgccaccuucacgaugcggcugcugucccccauccgcgugccgaacuacaaccucaucaucauggacgaggcccacuucaccgaccccgccagcaucgcggcccggggcuacaucuccacccgcguggagaugggcgaggccgccgggaucuucaugaccgccacgccgcccggcagccgggacccguucccccaguccaacgcgcccaucauggacgaggagcgcgagauccccgagcggagcuggaacuccgggcacgagugggucaccgacuucaagggcaagaccgugugguucgugccgagcaucaaggccgggaacgacaucgccgccugccugcgcaagaacggcaagaaggucauccagcugucccggaagaccuucgacagcgaguacaucaagacgcgcaccaacgacugggacuucguggugaccaccgacaucuccgagaugggcgcgaacuucaaggccgagcgggucaucgacccccgccggugcaugaagcccgugauccucacggacggggaggagcgcgugauccuggccggccccaugccggucacccacagcuccgccgcccagcggcgcgggcgggugggccgcaaccccaagaacgagagcgaccaguacaucuacaugggggagccccuggagaacgacgaggacugcgcgcacuggaaggaggccaagaugcuccuggacaacaucaacacccccgagggcaucaucccguccauguucgagcccgagcgcgagaaggucgacgccaucgacggcgaguaccggcugcgcggggaggcccggaagaccuucguggaccucaugcgccggggcgaccugcccguguggcuggccuaccgcgucgcggccgaggggaucaacuacgccgaccggcgcuggugcuucgacggcgugaagaacaaccagauccucgaggagaacguggaggucgagaucuggacgaaggagggggagcggaagaagcugaagccgcgcuggcuggacgcccggaucuacagcgacccccucgcccugaaggaguucaaggaguucgcggccggccgcaagucccugacccucaaccugaucaccgagaugggccggcugcccaccuucaugacgcagaaggcccgcaacgcccucgacaaccuggcggugcugcacaccgccgaggccgggggccgggccuacaaccacgcccucagcgagcugcccgagacccuggagacccuccugcugcucacgcugcuggcgaccgugaccgggggcaucuuccucuuccugauguccggcaaggggaucggcaagaugacccuggggaugugcugcaucaucaccgccagcauccuccugugguacgcccagauccagccgcacuggaucgccgccagcaucauccuggaguucuuccucaucguccugcugauccccgagcccgagaagcagcgcacgccccaggacaaccagcucaccuacguggugaucgcgauccugaccgucguggccgccaccauggccaacgagaugggcuuccuggagaagacgaagaaggacuucgggcucggcuccagcaccacccagcagcacgaguccaacauccuggacaucgaccugcggccggccagcgcguggacccucuacgccguggccacgaccuucaucacccccaugcugcgccacuccaucgagaacagcuccgucaacgugagccugaccgccaucgccaaccaggcgacggugcucaugggccuggggaagggcuggccccuguccaagauggacaucggggucccccuccuggccaucggcugcuacagccaggugaacccgaucacccugaccgccgcccuccugucccugguggcgcacuacgccaucaucgggcccggccuccaggccaaggccacccgggaggcccagaagcgcgcggccgccggcaucaugaagaaccccacggucgacgggaucaccgugaucgaccuggaccccaucccguacgaccccaaguucgagaagcagcugggccaggugaugcuccugguccugugcgugacccaggugcucaugaugcggaccacgugggcccugugcgaggcccugacccucgcgaccgggcccaucagcacccugugggagggcaaccccgggcgcuucuggaacacgaccaucgccgucuccauggccaacaucuuccgcggcagcuaccuggccggcgccgggcuccuguucuccaucaugaagaacaccgcgaacacccggcgcggcacggggaacaccggcgagacccugggcgagaaguggaagaaccggcucaacgcccuggggaaguccgaguuccagaucuacaagaaguccggcauccaggagguggaccgcacccuggccaaggaggggaucaagcggggcgagacggaccaccacgccgugagccgcggguccgcgaagcuccggugguucgucgagcgcaaccuggugaccccggagggcaagguggucgaccugggcugcgggcggggcggguggagcuacuacugcggcgggcucaagaacgugaaggaggugaagggccugaccaagggcgggcccggccacgaggagcccauccccaugagcaccuacggguggaaccugguccgccuccaguccggcguggacguguucuucacgccgcccgagaagugcgacacccugcugugcgacaucggggagagcucccccaaccccaccgucgaggccggccggacccuccgcgugcugaaccugguggagaacuggcucaacaacaacacccaguucugcaucaagguccugaacccguacaugcccagcgugaucgagaagauggaggcccugcagcggaaguacggcggggcccucgugcgcaacccccugucccggaacagcacgcacgagauguacugggucuccaacgccagcggcaacaucguguccagcgugaacaugaucucccgcaugcugaucaaccgguucaccaugcgccacaagaaggucaccuacgagccggacguggaccuggggagcggcacccggaacaucgggaucgaguccgagacgcccaaccucgacaucaucggcaagcgcaucgagaagaucaagcaggagcacgagaccagcuggcacuacgaccaggaccaccccuacaagaccugggcguaccacggcuccuacgagaccaagcagacggggagcgccuccagcauggugaacggcgucgugcgccugcugaccaagcccugggacgucaucccgauggugacccagauggccaugaccgacacgacccccuucgggcagcagcggguguucaaggagaaggucgacacccgcacccaggagcccaaggagggcacgaagaagcucaugaagaucaccgccgaguggcuguggaaggagcugggcaagaagaagacgccccggaugugcacccgcgaggaguucacgcggaaggugcgcuccaacgccgcgcucggggccaucuucaccgacgagaacaaguggaaguccgcccgggaggccguggaggacagcggcuucugggagcuggucgacaaggagcgcaaccugcaccucgaggggaagugcgagaccugcguguacaacaugaugggcaagcgggagaagaagcugggggaguucggcaaggccaagggcucccgcgcgaucugguacauguggcugggggcccgguuccucgaguucgaggcccugggcuuccugaacgaggaccacugguucagccgcgagaacucccucagcgggguggagggcgaggggcugcacaagcugggcuacauccuccgggacgucuccaagaaggagggcggggccauguacgcggacgacaccgccggcugggacacgcgcaucacccuggaggaccugaagaacgaggagauggugaccaaccacauggagggggagcacaagaagcucgccgaggccaucuucaagcugaccuaccagaacaaggugguccgggugcagcgcccgacgccccggggcaccgugauggacaucaucagccgccgggaccagcgcggguccggccaggucgugaccuacggccugaacaccuucacgaacauggaggcccagcucauccggcagauggagggggagggcguguucaagagcauccagcagcugaccgcgaccgaggagaucgccgucaagaacuggcuggugcgcguggggcgcgagcggcucucccgcauggccaucagcggcgacgacugcgucgugaagccccuggacgaccgguucgccuccgcccugaccgcgcucaacgacaugggcaaggugcgcaaggacauccagcagugggagcccagccggggguggaacgacuggacgcaggucccguucugcucccaccacuuccacgagcugaucaugaaggacggccgcgugcuggugguccccugccggaaccaggacgagcucaucgggcgcgcccggaucagccagggcgccggguggucccugcgcgagaccgccugccugggcaagagcuacgcccagauguggucccucauguacuuccaccggcgcgaccugcggcuggcggccaacgccaucugcagcgccgugcccagccacugggugcccaccucccgcaccaccuggagcauccacgccacgcacgaguggaugaccaccgaggacaugcucaccgucuggaaccggguguggauccaggagaacccguggauggaggacaagacgcccguggaguccugggaggagauccccuaccugggcaagcgcgaggaccaguggugcgggagccugaucggccucaccucccgggcgaccugggccaagaacauccagaccgccaucaaccagguccgcagccugaucgggaacgaggaguacacggacuacaugcccuccaugaagcgguuccgccgcgaggaggaggaggccggcgugcugugguga

SEQ ID NO: 9715 - RNA, 9876 nt, Artificial Sequence
  derived and/or modified CDS sequence (opt1) from DENV-2__JN851114__SS-prME
accgccggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugacguacgggaccugcaccgccaccggcgagcaccggcgggagaagcggagcgucgcccuggugccccacgugggcauggggcuggagacgcgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgugauggugcaggcggacuccgggugcgucgugagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgucacccgccuggagaaccugauguggaagcagaucacccccgagcucaaccacauccugaccgagaacgaggugaagcugacgaucaugaccggggacaucaagggcaucaugcaggccgggaagcggucccuccgcccgcagcccaccgagcugaaguacagcuggaaggcguggggcaaggccaagaugcuguccaccgagcuccacaaccacacguuccugaucgacggccccgagaccgccgagugcccgaacaccaaccgggccuggaacagccuggagguggaggacuacggguucggcgucuucaccacgaacaucuggcucaagcugaaggagcgccaggacguguucugcgacuccaagcugaugagcgccgcgaucaaggacaaccgggccgugcacgccgacaugggguacuggaucgaguccgcccucaacgacaccuggaagaucgagaaggccagcuucaucgaggucaaguccugccacuggcccaagagccacacccugugguccaacggcgugcuggagagcgagaugaucauccccaagaacuucgcgggccccgugucccagcacaacuaccgcccgggguaccacacccagaccgccggccccuggcaccucgggcggcuggagauggacuucgacuucugcgagggcacgaccgucguggugaccgaggacugcgggaaccgcggccccagccugcggaccacgaccgccagcggcaagcucaucaccgaguggugcugccgcuccugcacccugcccccgcugcgguaccgcggggaggacggcugcugguacgggauggagauccggccccucaaggagaaggaggagaaccuggucaacagccuggugacggccggccacgggcagaucgacaacuucucccucggcgugcugggcauggcgcuguuccucgaggagaugcugcgcacccgggucgggaccaagcacgccauccugcucguggccgugagcuucgucacccugaucacgggcaacauguccuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccagcaaggagcugaugaugaccaccaucgggaucguccugcucucccagagcacgauccccgaguccauccuggagcugaccgacgcccucgcgcugggcaugauggugcugaagaucguccggaacauggagaaguaccagcucgccgugaccaucauggccauccugugcgugccgaacgccgucauccugcagaacgccuggaaggugagcugcaccacgcucgcgguggucuccgugagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgugggcauggucagcauccuggccuccagccugcucaagaacgacauccccaugaccggcccccugguggccgggggccugcucacggugugcuacguccugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccggucuccauccccaucaccgccgccgcgugguaccugugggaggugaagaagcagcgcgccggggugcugugggacguccccagcccgccgcccguggagaaggccgagcucgaggacggcgccuaccggaucaagcagaaggggauccugggcuacucccagaucggggccggcguguacaaggagggcaccuuccacaccauguggcacgucacgcgcggggcggugcugaugcacaagggcaagcggaucgagcccagcugggccgacgugaagaaggaccucaucuccuacgggggcggguggaagcuggagggcgaguggaaggagggcgaggagguccaggugcuggcccucgagcccgggaagaacccccgcgccgugcagaccaagcccggccuguucaagaccaacaccgggacgaucggcgccgucagccuggacuucucccccgggaccagcggcucccccaucguggacaagaagggcaagguggucgggcucuacggcaacgggguggugacccggagcggcaccuacgucuccgcgaucgcccagacggagaaguccaucgaggacaaccccgagaucgaggacgacaucuuccgcaagaagcggcugaccaucauggaccugcaccccggcgccgggaagaccaagcgcuaccugcccgccaucgugcgggaggcgaucaagcgcggccuccggacccugauccuggccccgacgcgcguggucgccgccgagauggaggaggcccuccgcgggcugcccauccgguaccagacccccgcgauccgcgccgagcacaccggccgggagaucguggaccugaugugccacgccaccuucacgaugcgccuccugagccccauccgggugccgaacuacaaccugaucaucauggacgaggcccacuucaccgaccccgccuccaucgcggcccgcggguacaucagcacccgggucgagaugggcgaggccgccggcaucuucaugaccgccacgccgcccgggucccgcgacccguucccccagagcaacgcgcccaucauggacgaggagcgggagauccccgagcgcuccuggaacagcggccacgagugggugaccgacuucaaggggaagaccgugugguucgucccguccaucaaggccggcaacgacaucgccgccugccuccggaagaacgggaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccccggcgcugcaugaagcccgugauccugacggacggcgaggagcgggucauccucgccgggcccaugccggugacccacuccagcgccgcccagcgccggggccgcguggggcgcaaccccaagaacgagaacgaccaguacaucuacaugggcgagccccuggagaacgacgaggacugcgcgcacuggaaggaggccaagaugcugcucgacaacaucaacacccccgaggggaucaucccguccauguucgagcccgagcgggagaaggucgacgccaucgacggcgaguaccgccugcggggcgaggcccgcaagaccuucguggaccugaugcggcgcggggaccuccccgucuggcuggccuaccggguggcggccgagggcaucaacuacgccgaccgccgguggugcuucgacggggugaagaacaaccagauccuggaggagaacgucgagguggagaucuggacgaaggagggcgagcgcaagaagcucaagccgcgguggcuggacgcccgcaucuacagcgacccccuggcccucaaggaguucaaggaguucgcggccgggcggaagucccugacccugaaccucaucaccgagaugggccgccugcccaccuucaugacgcagaaggccaagaacgcccuggacaaccucgcggugcugcacaccgccgaggccggcgggcgggccuacaaccacgcccugagcgagcuccccgagacccuggagacccugcuccugcugacgcuccuggcgaccgucaccggcgggaucuuccuguuccucauguccggcaagggcaucgggaagaugacccugggcaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugaccuacguggucaucgcgauccucaccgugguggccgccaccauggccaacgagaugggguuccuggagaagacgaagaaggacuucggccuggggagcaucaccacccagcagccggagagcaacauccucgacaucgaccugcggcccgccuccgcguggacccuguacgccgucgccacgaccuucaucacccccaugcuccgccacagcaucgagaacuccagcgugaacgugucccugaccgccaucgccaaccaggcgacgguccugaugggccucggcaagggguggccccugagcaagauggacaucggcgugccgcugcucgccaucgggugcuacucccaggugaaccccaucacccugaccgccgcccugcuccugcuggucgcgcacuacgccaucaucggccccgggcuccaggccaaggccacccgggaggcccagaagcgcgcggccgccggcaucaugaagaaccccacgguggacggcaugaccgugaucgaccuggacccgauccccuacgaccccaaguucgagaagcagcuggggcaggucaugcuccuggugcugugcgugacccagguccucaugaugcggaccacgugggcccugugcgaggcccugacccucgcgaccggccccaucagcacccugugggaggggaacccgggccgcuucuggaacacgaccaucgccguguccauggccaacaucuuccgcgggagcuaccuggccggcgccggccuccuguucuccaucaugaagaacaccgcgaacacccggcgcgggacgggcaacaccggggagacccugggcgagaaguggaagaaccggcucaacgcccugggcaagagcgaguuccagaucuacaagaaguccgggauccaggagguggaccgcacccuggccaaggagggcaucaagcgcggggagacggaccaccacgccgucagccgcggcuccgcgaagcuccggugguucguggagcgcaaccuggugacccccgaggggaaggucguggaccugggcugcggccgcggcggguggagcuacuacugcggcgggcucaagaacgugaaggaggucaaggggcugaccaagggcgggcccgggcacgaggagcccaucccgauguccaccuacggcuggaaccuggugcgccuccagagcgggguggacgucuucuucacgccgcccgagaagugcgacacccugcugugcgacaucggcgaguccagccccaacccgaccguggaggccgggcggacccuccgcgugcugaaccuggucgagaacuggcucaacaacaacacccaguucugcaucaaggugcugaaccccuacaugcccagcgugaucgagaagauggaggcccugcagcggaaguacggcggcgcccugguccgcaacccgcucucccggaacagcacgcacgagauguacuggguguccaacgccagcgggaacaucguguccagcgucaacaugaucucccgcaugcugaucaaccgguucaccaugcgccacaagaaggcgaccuacgagcccgacguggaccugggcagcgggacccggaacaucggcaucgaguccgagacgcccaaccucgacaucaucgggaagcgcaucgagaagaucaagcaggagcacgagaccagcuggcacuacgaccaggaccaccccuacaagaccugggccuaccacggcuccuacgagaccaagcagacgggcagcgccuccagcauggugaacggggucgugcgccugcugaccaagccgugggacgugauccccauggucacccagauggccaugaccgacacgacccccuucggccagcagcggguguucaaggagaaggucgacacccgcacccaggagcccaaggaggggacgaagaagcucaugaagaucaccgccgaguggcuguggaaggagcugggcaagaagaagaccccgcggaugugcacccgcgaggaguucacgcggaaggugcgcuccaacgcggcccucggcgccaucuucaccgacgagaacaaguggaaguccgcccgggaggccguggaggacuccggguucugggagcuggucgacaaggagcgcaaccugcaccucgagggcaagugcgagaccugcguguacaacaugauggggaagcgggagaagaagcugggcgaguucgggaaggcgaagggcagccgcgccaucugguacauguggcugggcgcccgguuccucgaguucgaggcccugggguuccugaacgaggaccacugguucucccgcgagaacagccucagcggcguggagggggagggccugcacaagcugggguacauccuccgggacgucuccaagaaggagggcggcgcgauguacgccgacgacaccgccgggugggacacgcgcaucacccuggaggaccugaagaacgaggagauggugaccaaccacauggagggcgagcacaagaagcucgccgaggccaucuucaagcugaccuaccagaacaaggugguccgggugcagcgccccacgccccgggggaccgugauggacaucaucagccgccgggaccagcgcggcuccgggcaggucgugaccuacggccugaacaccuucacgaacauggaggcgcagcucauccggcagauggagggcgaggggguguucaagagcauccagcagcugaccgucaaggaggagaucgccgugaagaacuggcugauccgcgugggccgcgagcggcucucccgcauggccaucagcggggacgacugcgucgugaagccccuggacgaccgguucgccuccgcccugaccgcgcucaacgacaugggcaaggugcgcaaggacauccagcagugggagccgagccggggcuggaacgacuggacccagguccccuucugcucccaccacuuccacgagcugaucaugaaggacgggcgcgugcuggugguccccugccggaaccaggacgagcucaucggccgcgcccggaucagccagggggccggcuggucccugcgcgagacggccugccugggcaagagcuacgcccagauguggucccucauguacuuccaccggcgcgaccugcggcuggcggccaacgccaucugcagcgccgugcccucccacugggugccgaccagccgcaccaccugguccauccacgccacccacgaguggaugacgaccgaggacaugcucaccgucuggaaccggguguggauccaggagaaccccuggauggaggacaagacccccguggagagcugggaggagauccccuaccugggcaagcgcgaggaccaguggugcggcagccugaucgggcucacgucccgggcgaccugggccaagaacauccagaccgccaucaaccagguccgcagccugaucggcaacgaggaguacaccgacuacaugccguccaugaagcgguuccgccgcgaggaggaggaggccggggugcugugguga

SEQ ID NO: 9716 - RNA, 9876 nt, Artificial Sequence
  derived and/or modified CDS sequence (opt1) from DENV-2__JN851126__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggggagcugugcgaggacaccaucaccuacaacugcccccugcucaagcagaacgagcccgaggacaucgacugcuggugcaacagcaccagcaccugggugaccuacgggaccugcaccgccaccggcgagcaccgccgggagaagcgcagcgucgcccuggugccccacgugggcauggggcuggagacccggaccgagaccuggauguccagcgagggcgccuggaagcacgcccagcgcaucgagaccuggguccuccggcaccccggguucacgaucauggcggccauccuggccuacaccaucggcaccaccuacuuccagcgcgugcugaucuucauccuccugacggccguggcgcccuccaugaccaugcggugcaucgggaucagcaaccgcgacuucgucgagggcguguccggcgggagcuggguggacaucguccuggagcacggcuccugcgugaccaccauggccaagaacaagcccacgcucgacuucgagcugaucaagaccgaggccaagcaccccgccacccugcggaaguacugcaucgaggccaagcucaccaacacgaccaccgcgagccgcugcccgacccagggggagcccucccugaacgaggagcaggacaagcgguucgugugcaagcacagcauggucgaccgcggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccggaccggccuggacuucaacgagauggugcuccugcagauggagaacaaggccuggcuggugcaccgccagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccggcugcgcauggacaagcugcagcucaagggcaugagcuacuccaugugcaccgggaaguucaagguggucaaggagaucgcggagacccagcacggcaccaucgugauccgggugcaguacgagggggacggcagccccugcaagauccccuucgagaucauggaccuggagaagcgccacguccugggccggcucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcgcauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgguccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccgcagcgugacccggcuggagaaccugauguggaagcagaucacccccgagcucaaccacauccuguccgagaacgagaucaagcugaccaucaugacgggggacaucaagggcaucaugcaggccgggaagcgcagccuccggccgcagcccaccgagcugaaguacuccuggaaggcguggggcaaggccaagaugcugagcaccgagcuccacaaccacaccuuccugaucgacggccccgagacggccgagugcccgaacaccaaccgcgccuggaacucccuggaggucgaggacuacggguucggcguguucaccaccaacaucuggcucaagcugaaggagcggcaggacguguucugcgacagcaagcugauguccgccgcgaucaaggacaaccgcgccguccacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccggccgggguaccacacccagaccgccggccccuggcaccucgggcgccuggagauggacuucgacuucugcgagggcaccacggugguggucaccgaggacugcgggaaccggggccccagccugcgcaccaccacggccuccggcaagcucaucaccgaguggugcugccggagcugcacccugcccccgcugcgcuaccgcggggaggacggcugcugguacgggauggagauccgcccccucaaggagaaggaggagaaccuggugaacucccuggugaccgccggccacgggcagaucgacaacuucagccucggcguccugggcauggcgcuguuccucgaggagaugcugcggacgcgcguggggaccaagcacaccauccugcucguggccgucuccuucgugacccugaucacgggcaacaugagcuuccgggaccuggggcgcguggucgugauggugggcgccaccaugaccgacgacaucgggaugggcgucaccuaccucgcccugcuggccgcguucaaggugcgccccacguucgccgccggccuccugcugcggaagcucaccuccaaggagcugaugaugaccaccaucgggaucgugcugcucagccaguccacgauccccgagaccauccuggagcugaccgacgcccucgcccugggcaugaugguccugaagaucgugcgcaacauggagaaguaccagcucgcggucaccaucauggccauccugugcgugccgaacgccgugauccugcagaacgccuggaaggucagcugcacggcccucgcggugguguccgucagcccccugcugcucaccuccagccagcagaaggccgacuggaucccccuggcccugaccaucaaggggcucaaccccaccgccaucuuccugacgacccugucccggaccagcaagaagcgcuccuggccgcucaacgaggcgaucauggccgugggcauggugagcauccuggccuccagccugcucaagaacgacauccccaugaccggcccccuggucgccgggggccugcucacggugugcuacgugcugaccgggcggagcgccgaccuggagcucgagcgcgcggccgacguccggugggaggagcaggccgagaucuccggcagcucccccauccugagcaucaccaucuccgaggacgggagcauguccaucaagaacgaggaggaggagcagacccugacgauccucauccgcaccggccugcuggugaucagcggccucuucccgguguccauccccaucaccgccgccgcgugguaccugugggaggucaagaagcagcgggccggggugcugugggacgugcccagcccgccgcccgucggcaaggccgagcucgaggacggggccuaccgcaucaagcagaagggcauccugggguacucccagaucggcgccggcguguacaaggaggggaccuuccacaccauguggcacgugacgcggggcgcgguccugaugcacaaggggaagcgcaucgagcccagcugggccgacgugaagaaggaccucaucuccuacggcgggggcuggaagcuggagggcgaguggaaggagggggaggaggugcagguccuggcccucgagcccggcaagaacccccgggccgugcagaccaagcccgggcuguucaagaccaacaccggcacgaucggggccgugagccuggacuucucccccggcaccagcggcucccccaucgucgacaagaaggggaagguggugggccucuacgggaacggcgucgugacccgcagcggcaccuacguguccgcgaucgcccagacggagaaguccaucgaggacaaccccgagaucgaggacgacaucuuccggaagaagcgccugaccaucauggaccugcaccccggggccggcaagaccaagcgguaccugcccgccaucguccgcgaggcgaucaagcgggggcuccgcacccugauccuggccccgacgcgggugguggccgccgagauggaggaggcccuccgcggccugcccauccgcuaccagacccccgcgauccgggccgagcacaccgggcgcgagaucgucgaccugaugugccacgccaccuucacgaugcggcuccugagccccauccgcgugccgaacuacaaccugaucaucauggacgaggcccacuucaccgaccccgccuccaucgcggcccggggcuacaucagcacccgcguggagaugggcgaggccgccgggaucuucaugaccgccacgccgcccggcucccgggacccguucccccagagcaacgcgcccaucauggacgaggagaaggagauccccgagcgcuccuggaacagcgggcacgagugggucaccgacuucaagggcaagaccgugugguucgugccguccaucaaggccgggaacgacaucgccgccugccuccggaagaacggcaagaaggucauccagcugagccgcaagaccuucgacuccgaguacaucaagacgcggaccaacgacugggacuucguggugaccaccgacaucagcgagaugggcgcgaacuucaaggccgagcgcgucaucgacccccggcgcugcgugaagcccgugauccugacggacggggaggagcgggucauccucgccggccccaugccggugacccacuccagcgccgcccagcgccgggggcgcgugggccggaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaaggucgacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgugaagaacaaccagauccuggaggagaacgucgagguggagaucuggacgaaggagggggagcgcaagaagcucaagccgcgguggcuggacgcccgcaucuacagcgacccccuggcccucaaggaguucaaggaguucgcggccggccggaagucccugacccugaaccucaucaccgagaugggccgccugcccaccuucaugacgcagaaggcccggaacgcccuggacaaccucgcggugcugcacaccgccgaggccgggggccgcgccuacaaccacgcccugagcgagcuccccgagacccuggagacccugcuccugcugacgcuccuggcgaccgucaccgggggcaucuuccuguuccucauguccggcaaggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugaccuacguggucaucgcgauccucaccgugguggccgccaccauggccaacgagaugggcuuccuggagaagacgaagaaggacuucgggcugggcagcaucaccacccagcagccggagagcaacauccucgacaucgaccugcgccccgccuccgcguggacccuguacgccgucgccacgaccuucaucacccccaugcuccggcacagcaucgagaacuccagcgugaacgugucccugaccgccaucgccaaccaggcgacgguccugaugggccucgggaagggcuggccccugagcaagauggacaucggggugccgcugcucgccaucggcugcuacucccaggugaaccccaucacccugaccgccgcccugcuccugcuggucgcgcacuacgccaucaucgggcccggccuccaggccaaggccacccgcgaggcccagaagcgggcggccgccggcaucaugaagaaccccacgguggacgggaucaccgugaucgaccuggacccgauccccuacgaccccaaguucgagaagcagcugggccaggucaugcuccuggugcugugcgugacccagguccucaugaugcgcaccacgugggcccugugcgaggcccugacccucgcgaccgggcccaucagcacccugugggagggcaacccggggcgguucuggaacacgaccaucgccguguccauggccaacaucuuccgcggcagcuaccuggccggcgccgggcuccuguucuccaucaugaagaacaccgcgaacacccgccggggcacggggaacaccggcgagacccugggcgagaaguggaagaaccgccucaacgcccugggcaagagcgaguuccagaccuacaagaaguccggcauccaggagguggaccggacgcuggccaaggaggggaucaagcgcggcgagaccgaccaccacgccgucagccggggguccgcgaagcuccgcugguucguggagcggaaccuggugacccccgagggcaaggucguggaccugggcugcgggcgcggcggguggagcuacuacugcggcgggcucaagaacgugaaggaggucaagggccugaccaagggcgggcccggccacgaggagcccaucccgauguccacguacggguggaaccuggugcggcuccagagcggcguggacgucuucuucacgccgcccgagaagugcgacacccugcugugcgacaucggggaguccagccccaacccgaccguggaggccggccgcacccuccgggugcugaaccuggucgagaacuggcucaacaacaacacgcaguucugcaucaaggugcugaaccccuacaugcccagcgugaucgagaagauggagacccugcagcgcaagcacggcggggcccugguccggaacccgcucucccgcaacagcacccacgagauguacuggguguccaacgccagcggcaacaucguguccagcgucaacaugaucucccggaugcugaucaaccgcuucaccaugcggcacaagaaggccacguacgagcccgacguggaccuggggagcggcacccgcaacaucgggaucgaguccgagacccccaaccucgacaucaucggcaagcggaucgagaagaucaagcaggagcacgagaccagcuggcacuacgaccaggaccaccccuacaagacgugggcguaccacggcuccuacgagaccaagcagaccgggagcgccuccagcauggugaacggcgucgugcgccugcugaccaagccgugggacgugauccccauggucacgcagauggccaugaccgacaccacccccuucgggcagcagcgcguguucaaggagaaggucgacacgcggacccaggagcccaaggagggcaccaagaagcucaugaagaucaccgccgaguggcuguggaaggagcugggcaagaagaagacgccgcgcaugugcacccgggaggaguucacccgcaaggugcgguccaacgccgcgcucggggccaucuucaccgacgagaacaaguggaaguccgcccgcgaggccguggaggacucccgguucugggagcuggucgacaaggagcgcaaccugcaccucgagggcaagugcgagacgugcguguacaacaugauggggaagcgggagaagaagcugggcgaguucgggaaggccaagggcagccgcgcgaucugguacauguggcugggcgcccgguuccucgaguucgaggcccugggguuccugaacgaggaccacugguucucccgcgagaacagccucagcggcguggagggggagggccugcacaagcugggguacauccuccgggacgucuccaagaaggagggcggcgccauguacgcggacgacaccgccgggugggacacccgcaucacccuggaggaccugaagaacgaggagauggugacgaaccacauggagggcgagcacaagaagcucgccgaggccaucuuccggcugaccuaccagaacaaggugguccgcgugcagcggcccacgccccgggggaccgugauggacaucaucagccggcgcgaccagcggggcuccgggcaggucgugacguacggccugaacaccuucaccaacauggaggcccagcucauccgccagauggagggcgaggggguguucaagagcauccagcaccugaccgucacggaggagaucgcggugaagaacuggcuggugcgcgucggccgggagcgccucucccggauggccaucagcggggacgacugcguggugaagccccuggacgaccgcuucgccuccgcccugaccgcccucaacgacaugggcaagguccggaaggacauccagcagugggagccgagccgcggcuggaacgacuggacccaggugcccuucugcucccaccacuuccacgagcugaucaugaaggacgggcgggugcuggucgugcccugccgcaaccaggacgagcucaucggccgggcgcgcaucagccagggggccggcuggucccugcgggagaccgccugccugggcaagagcuacgcccagauguggucccucauguacuuccaccgccgggaccugcgccuggccgcgaacgccaucugcagcgccgugcccucccacugggucccgaccagccggacgaccugguccauccacgccacccacgaguggaugaccacggaggacaugcucaccguguggaaccgcguguggauccaggagaaccccuggauggaggacaagacccccgucgagagcugggaggagauccccuaccugggcaagcgggaggaccaguggugcggcagccugaucgggcucaccucccgcgccacgugggcgaagaacauccagaccgccaucaaccaggugcggagccugaucggcaacgaggaguacaccgacuacaugccguccaugaagcgcuuccgccgggaggaggaggaggccggggugcugugguga

SEQ ID NO: 9717 - RNA, 9876 nt, Artificial Sequence
  derived and/or modified CDS sequence (opt1) from DENV-2__JN851121__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgcgauggugcaggccgacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccugaccgagaacgaggucaagcugacgaucaugaccggggacaucaagggcaucaugcaggcggggaagcggucccuccgcccgcagcccaccgagcugaaguacagcuggaaggccuggggcaaggccaagaugcuguccaccgagcuccacaaccacacguuccugaucgacggccccgagaccgccgagugcccgaacaccaaccgggccuggaacagccuggagguggaggacuacggguucggcguguucaccacgaacaucuggcucaagcugaaggagcgccaggacgucuucugcgacuccaagcugaugagcgcggccaucaaggacaaccgggccgugcacgccgacaugggguacuggaucgaguccgcccucaacgacaccuggaagaucgagaaggcgagcuucaucgaggugaaguccugccacuggcccaagagccacacccugugguccaacggcguccuggagagcgagaugaucauccccaagaacuucgccggccccgugucccagcacaacuaccgcccgggguaccacacccagaccgccggccccuggcaccucgggcggcuggagauggacuucgacuucugcgagggcacgaccguggucgugaccgaggacugcgggaaccgcggccccagccugcggaccacgaccgccagcggcaagcucaucaccgaguggugcugccgcuccugcacccugcccccgcugcgguaccgcggggaggacggcugcugguacgggauggagauccggccccucaaggagaaggaggagaaccuggugaacagccuggucacggcgggccacgggcagaucgacaacuucucccucggcgugcugggcauggcccuguuccucgaggagaugcugcgcacccggguggggaccaagcacgccauccugcucgucgccgugagcuucgugacccugaucacgggcaacauguccuuccgcgaccuggggcgcgucauggugauggugggcgccaccaugaccgacgacaucgggaugggcgucaccuaccucgcgcugcuggccgccuucaaggugcggcccacguucgccgccggccuccugcugcgcaagcucaccagcaaggagcugaugaugaccaccaucgggaucgugcugcucucccagagcacgauccccgaguccauccuggagcugaccgacgcgcucgcccugggcaugaugguccugaagaucgugcggaacauggagaaguaccagcucgccgucaccaucauggccauccugugcgugccgaacgccgugauccugcagaacgcguggaaggucagcugcaccacgcucgccgugguguccgucagcccccugcugcucaccuccagccagcagaaggccgacuggaucccccuggcccugaccaucaaggggcucaaccccaccgcgaucuuccugacgacccugucccgcaccagcaagaagcgguccuggccgcucaacgaggccaucauggccgugggcauggugagcauccuggccuccagccugcucaagaacgacauccccaugaccggcccccuggucgccgggggccugcucacggugugcuacgugcugaccgggcgcagcgcggaccuggagcucgagcgggccgccgacguccgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccgguguccauccccaucaccgccgcggccugguaccugugggaggucaagaagcagcgcgccggggugcugugggacgugcccagcccgccgcccgucggcaaggccgagcucgaggacggggccuaccggaucaagcagaagggcauccugggguacucccagaucggcgcgggcguguacaaggaggggaccuuccacaccauguggcacgugacgcgcggcgccguccugaugcacaaggggaagcggaucgagcccagcugggccgacgugaagaaggaccucaucuccuacggcgggggcuggaagcuggagggcgaguggaaggagggggaggaggugcagguccuggcccucgagcccggcaagaacccccgcgccgugcagaccaagcccgggcuguucaagaccaacaccggcacgaucggggcggugagccuggacuucucccccggcaccagcggcucccccaucgucgacaagaaggggaagguggugggccucuacgggaacggcgucgugacccggagcggcaccuacguguccgccaucgcccagacggagaaguccaucgaggacaaccccgagaucgaggacgacaucuuccgcaagaagcggcugaccaucauggaccugcaccccggggccggcaagaccaagcgcuaccugcccgcgaucguccgggaggccaucaagcgcgggcuccggacccugauccuggccccgacgcgcgugguggccgccgagauggaggaggcgcuccgcggccugcccauccgguaccagacccccgccauccgcgccgagcacaccgggcgggagaucgucgaccugaugugccacgccaccuucacgaugcgccuccugagccccauccgggugccgaacuacaaccugaucaucauggacgaggcccacuucaccgaccccgcguccaucgccgcccgcggcuacaucagcacccggguggagaugggcgaggccgccgggaucuucaugaccgcgacgccgcccggcucccgcgacccguucccccagagcaacgcccccaucauggacgaggagcgggagauccccgagcgcuccuggaacagcgggcacgagugggucaccgacuucaagggcaagaccgugugguucgugccguccaucaaggccgggaacgacaucgccgcgugccuccggaagaacggcaagaaggucauccagcugagccgcaagaccuucgacuccgaguacaucaagacgcggaccaacgacugggacuucguggugaccaccgacaucagcgagaugggcgccaacuucaaggccgagcgcgucaucgacccccggcgcugcaugaagcccgugauccugacggacggggaggagcgggugauccucgccggccccaugccggucacccacuccagcgccgcgcagcgccgggggcgcgugggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgccaucgacggcgaguaccgccugcgcggggaggcccgcaagaccuucgucgaccugaugcggcgcggcgaccuccccguguggcuggcguaccgggucgccgccgaggggaucaacuacgccgaccgccgguggugcuucgacggcgugaagaacaaccagauccuggaggagaacguggaggucgagaucuggacgaaggagggggagcgcaagaagcucaagccgcgguggcuggacgcccgcaucuacagcgacccccuggcgcucaaggaguucaaggaguucgccgccggccggaagucccugacccugaaccucaucaccgagaugggccgccugcccaccuucaugacgcagaaggccaagaacgcgcuggacaaccucgccgugcugcacaccgccgaggccgggggccgggccuacaaccacgcgcugagcgagcuccccgagacccuggagacccugcuccugcugacgcuccuggccaccgugaccgggggcaucuuccuguuccucauguccggcaaggggaucggcaagaugacccuggggaugugcugcaucaucaccgccagcauccugcucugguacgcccagauccagccgcacuggaucgccgcguccaucauccuggaguucuuccugaucguccuccugauccccgagcccgagaagcagcgcacgccccaggacaaccagcugaccuacguggugaucgccauccucaccgucguggccgccaccauggccaacgagaugggcuuccuggagaagacgaagaaggacuucgggcugggcagcaucaccaaccagcagccggagagcaacauccucgacaucgaccugcggcccgcguccgccuggacccuguacgccguggccaccacguucaucacccccaugcuccgccacagcaucgagaacuccagcgucaacgugucccugaccgccaucgcgaaccaggccaccgugcugaugggccucgggaagggcuggccccugagcaagauggacaucggggucccgcugcucgccaucggcugcuacucccaggugaaccccaucacgcugaccgccgcgcugcuccugcugguggcccacuacgccaucaucgggcccggccuccaggccaaggccacccgggaggcgcagaagcgcgccgccgccggcaucaugaagaaccccaccgucgacgggaugacggugaucgaccuggacccgauccccuacgaccccaaguucgagaagcagcugggccaggugaugcuccugguccugugcgugacccaggugcucaugaugcggaccaccugggcccugugcgaggcgcugacgcucgccaccgggcccaucagcacccugugggagggcaacccggggcgcuucuggaacaccacgaucgccgucuccauggccaacaucuuccgcggcagcuaccuggccggcgcggggcuccuguucuccaucaugaagaacaccgccaacacccggcgcggcaccgggaacacgggcgagacccugggcgagaaguggaagaaccggcucaacgcccugggcaagagcgaguuccagaucuacaagaaguccggcauccaggagguggaccgcacccuggccaaggaggggaucaagcggggcgagaccgaccaccacgcggugagccgcggguccgccaagcuccggugguucgucgagcgcaaccuggugacgcccgagggcaagguggucgaccugggcugcgggcggggcggguggagcuacuacugcggcgggcucaagaacgugaaggaggugaagggccugaccaagggcgggcccggccacgaggagcccaucccgauguccaccuacggguggaaccugguccgccuccagagcggcguggacguguucuucacgccgcccgagaagugcgacacgcugcugugcgacaucggggaguccagccccaacccgaccgucgaggccggccggacccuccgcgugcugaaccugguggagaacuggcucaacaacaacacccaguucugcaucaagguccugaaccccuacaugcccagcgugaucgagaagauggaggcccugcagcggaaguacggcggggcccuggugcgcaacccgcucucccggaacagcacccacgagauguacugggucuccaacgcgagcggcaacaucguguccagcgugaacaugaucucccgcaugcugaucaaccgguucacgaugcgccacaagaaggccaccuacgagcccgacgucgaccuggggagcggcacccggaacaucgggaucgaguccgagacccccaaccucgacaucaucggcaagcgcaucgagaagaucaagcaggagcacgagacgagcuggcacuacgaccaggaccaccccuacaagaccugggccuaccacggcuccuacgagaccaagcagaccgggagcgccuccagcauggugaacggcgugguccgccugcugacgaagccgugggacgugauccccauggugacccagauggccaugaccgacaccacgcccuucgggcagcagcgggucuucaaggagaagguggacacccgcacccaggagcccaaggagggcaccaagaagcucaugaagaucacggcggaguggcuguggaaggagcugggcaagaagaagaccccgcggaugugcacccgcgaggaguucacccggaagguccgcuccaacgccgcccucggggccaucuucacggacgagaacaaguggaaguccgcccgggaggcgguggaggacuccggcuucugggagcugguggacaaggagcgcaaccugcaccucgaggggaagugcgagaccugcgucuacaacaugaugggcaagcgggagaagaagcugggggaguucggcaaggccaagggcagccgcgccaucugguacauguggcugggggcccgguuccucgaguucgaggcgcugggcuuccugaacgaggaccacugguucucccgcgagaacagccucagcgggguggagggcgaggggcugcacaagcugggcuacauccuccgggacguguccaagaaggagggcggggccauguacgccgacgacaccgccggcugggacacccgcaucacgcuggaggaccugaagaacgaggagauggucaccaaccacauggagggggagcacaagaagcucgccgaggcgaucuucaagcugaccuaccagaacaagguggugcggguccagcgccccacgccccggggcacggugauggacaucaucagccgccgggaccagcgcggguccggccagguggucaccuacggccugaacaccuucaccaacauggaggcccagcucauccggcagauggagggggagggcguguucaagagcauccagcagcugacggugaaggaggagaucgccgucaagaacuggcugauccgcguggggcgcgagcggcucucccgcauggccaucagcggcgacgacugcguggucaagccccuggacgaccgguucgccuccgcgcugaccgcccucaacgacaugggcaaggugcgcaaggacauccagcagugggagccgagccggggguggaacgacuggacccaggugcccuucugcucccaccacuuccacgagcugaucaugaaggacggccgcguccugguggugcccugccggaaccaggacgagcucaucgggcgcgcccggaucagccagggcgccggguggucccugcgcgagaccgccugccugggcaagagcuacgcgcagauguggucccucauguacuuccaccggcgcgaccugcggcuggccgccaacgccaucugcagcgccguccccucccacugggugccgacgagccgcaccaccugguccauccacgcgacccacgaguggaugaccacggaggacaugcucaccguguggaaccgggucuggauccaggagaaccccuggauggaggacaagacccccguggagagcugggaggagauccccuaccugggcaagcgcgaggaccaguggugcgggagccugaucggccucaccucccgggccacgugggccaagaacauccagaccgccaucaaccaggugcgcagccugaucgggaacgaggaguacaccgacuacaugccguccaugaagcgguuccgccgcgaggaggaggaggcgggcguccugugguga

SEQ ID NO: 9718 - RNA, 9876 nt, Artificial Sequence
  derived and/or modified CDS sequence (opt1) from DENV-2__JN851115__SS-prME
accgcgggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcaguggcuccuggaccugccccuccccuggcugccgggcgcggacacccagggguccaacuggauccagaaggagacccuggugacguucaagaacccccacgccaagaagcaggacgucguggugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcucggccgccugaucacggugaacccgaucgucaccgagaaggacucccccgugaacaucgaggccgagccgcccuucggggacagcuacaucaucaucggcguggagccggggcagcugaagcucuccugguucaagaagggcagcuccaucgggcagauguucgagaccaccaugcgcggcgccaagcggauggccauccugggcgacacggccugggacuucgggagccugggcggggucuucaccuccaucggcaaggcgcuccaccagguguucggggccaucuacggcgccgccuucagcggcguguccuggaccaugaagauccugaucggggucgugaucaccuggaucggcaugaacagccgcuccacgagccuguccgugagccugguccucguggggguggucacccuguaccugggcgugauggugcaggcggacuccgggugcgucgugagcuggaagaacaaggagcucaagugcggcagcggcaucuucaucaccgacaacgugcacaccuggacggagcaguacaaguuccagcccgagucccccagcaagcuggccuccgccauccagaaggcccacgaggaggggaucugcggcauccggagcgucacccgccuggagaaccucauguggaagcagaucacccccgagcugaaccacauccugaccgagaacgaggugaagcucacgaucaugaccggggacaucaagggcaucaugcaggccgggaagcggucccugcgcccgcagcccaccgagcugaaguacagcuggaaggcguggggcaaggccaagaugcucuccaccgagcugcacaaccacacguuccugaucgacggccccgagaccgccgagugcccgaacaccaaccgggccuggaacagccucgagguggaggacuacggguucggcgucuucaccacgaacaucuggcugaagcugaaggagcgccaggacguguucugcgacuccaagcucaugagcgccgcgaucaaggacaaccgggccgugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgcgggccccgugucccagcacaacuaccgcccgggguaccacacccagaccgccggccccuggcaccuggggcggcuggagauggacuucgacuucugcgagggcacgaccgucguggugaccgaggacugcgggaaccgcggccccagccuccggaccacgaccgccagcggcaagcugaucaccgaguggugcugccgcuccugcacccugcccccgcuccgguaccgcggggaggacggcugcugguacgggauggagauccggccccugaaggagaaggaggagaaccuggucaacagccucgugacggccggccacgggcagaucgacaacuucucccugggcgugcugggcauggcccucuuccuggaggagaugcugcgcacccgggucgggaccaagcacgccauccuccugguggccgugagcuucgucacccugaucacgggcaacauguccuuccgcgaccucgggcgcgugauggugauggucggcgccaccaugaccgacgacaucgggaugggcgugaccuaccuggcccugcucgcggccuucaaggugcggcccacguucgccgccggccugcugcuccgcaagcugaccagcaaggagcugaugaugaccaccaucgggaucguccuccugucccagagcacgauccccgaguccauccuggagcucaccgacgcccuggcgcugggcaugauggugcucaagaucguccggaacauggagaaguaccagcuggccgugaccaucauggccauccugugcgugccgaacgccgucauccuccagagcgccuggaagguguccugcaccacgcuggcgguggucagcgugagcccccugcuccugaccagcucccagcagaaggccgacuggaucccccuggcccucaccaucaaggggcugaaccccaccgccaucuuccugacgacccucagccgcaccuccaagaagcggagcuggccgcugaacgaggcgaucauggccgugggcauggucuccauccuggccagcagccuccugaagaacgacauccccaugaccggcccccugguggccgggggccuccugacggugugcuacguccugaccgggcgcuccgccgaccucgagcuggagcgggcggccgacgugcgcugggaggagcaggccgagaucagcggcuccagccccauccuguccaucaccaucagcgaggacggguccaugagcaucaagaacgaggaggaggagcagacccucacgauccugauccggaccggccugcucgugaucuccggccuguucccggucagcauccccaucaccgccgccgcgugguaccugugggaggugaagaagcagcgcgccggggugcucugggacguccccagcccgccgcccgugggcaaggccgagcuggaggacggggccuaccggaucaagcagaagggcauccugggguacagccagaucggcgccggcguguacaaggaggggaccuuccacaccauguggcacgucacgcgcggcgcggugcucaugcacaaggggaagcggaucgagcccuccugggccgacgugaagaaggaccugaucagcuacggcgggggcuggaagcuggagggcgaguggaaggagggggaggagguccaggugcucgcccuggagcccggcaagaacccccgcgccgugcagaccaagcccgggcuguucaagaccaacaccggcacgaucggggccgucucccucgacuucagccccggcaccuccggcagccccaucguggacaagaaggggaagguggucggccuguacgggaacggcguggugacccgguccggcaccuacgucagcgcgaucgcccagacggagaaguccaucgaggacaaccccgagaucgaggacgacaucuuccgcaagaagcggcugaccaucauggaccugcaccccggggccggcaagaccaagcgcuaccuccccgccaucgugcgggaggcgaucaagcgcgggcugcggacccugauccucgccccgacgcgcguggucgccgccgagauggaggaggcccugcgcggccugcccauccgguaccagacccccgcgauccgcgccgagcacaccgggcgggagaucguggaccucaugugccacgccaccuucacgaugcgccugcugucccccauccgggugccgaacuacaaccucaucaucauggacgaggcccacuucaccgaccccgccagcaucgcggcccgcggcuacaucuccacccgggucgagaugggcgaggccgccgggaucuucaugaccgccacgccgcccggcagccgcgacccguucccccaguccaacgcgcccaucauggacgaggagcgggagauccccgagcgcagcuggaacuccgggcacgagugggugaccgacuucaagggcaagaccgugugguucgucccgagcaucaaggccgggaacgacaucgccgccugccugcggaagaacggcaagaaggugauccagcugucccgcaagaccuucgacagcgaguacaucaagacgcggaccaacgacugggacuucguggucaccaccgacaucuccgagaugggcgcgaacuucaaggccgagcgcgugaucgacccccggcgcugcaugaagcccgugauccucacggacggggaggagcgggucauccuggccggccccaugccggugacccacagcuccgccgcccagcgccgggggcgcgugggccgcaaccccaagaacgagaacgaccaguacaucuacaugggggagccccuggagaacgacgaggacugcgcgcacuggaaggaggccaagaugcuccuggacaacaucaacacccccgagggcaucaucccgagcauguucgagcccgagcgggagaaggucgacgccaucgacggcgaguaccgccugcgcggggaggcccgcaagaccuucguggaccucaugcggcgcggcgaccugcccgucuggcuggccuaccggguggcggccgaggggaucaacuacgccgaccgccgguggugcuucgacggcgugaagaacaaccagauccucgaggagaacgucgagguggagaucuggacgaaggagggggagcgcaagaagcugaagccgcgguggcuggacgcccgcaucuacuccgacccccucgcccugaaggaguucaaggaguucgcggccggccggaagucccugacccucaaccugaucaccgagaugggccgccugcccaccuucaugacgcagaaggccaagaacgcccucgacaaccuggcggugcugcacaccgccgaggccgggggccgggccuacaaccacgcccucuccgagcugcccgagacccuggagacccuccugcugcucacgcugcuggcgaccgucaccgggggcaucuuccucuuccugaugagcggcaaggggaucggcaagaugacccuggggaugugcugcaucaucaccgccuccauccuccugugguacgcccagauccagccgcacuggaucgccgccagcaucauccuggaguucuuccucaucgugcugcugauccccgagcccgagaagcagcgcacgccccaggacaaccagcucaccuacguggucaucgcgauccugaccgugguggccgccaccauggccaacgagaugggcuuccuggagaagacgaagaaggacuucgggcucggcagcaucaccacccagcagccggaguccaacauccuggacaucgaccugcggcccgccagcgcguggacccucuacgccgucgccacgaccuucaucacccccaugcugcgccacuccaucgagaacagcuccgugaacgugagccugaccgccaucgccaaccaggcgacgguccucaugggccuggggaagggcuggccccuguccaagauggacaucggggugccgcuccuggccaucggcugcuacagccaggugaaccccaucacccugaccgccgcccuccugcugcucgucgcgcacuacgccaucaucgggcccggccugcaggccaaggccacccgggaggcccagaagcgcgcggccgccggcaucaugaagaaccccacgguggacgggaugaccgugaucgaccuggacccgauccccuacgaccccaaguucgagaagcagcucggccaggucaugcugcuggugcucugcgugacccagguccugaugaugcggaccacgugggcccugugcgaggcccucacccuggcgaccgggcccaucuccacccugugggagggcaacccggggcgcuucuggaacacgaccaucgccgugagcauggccaacaucuuccgcggcuccuaccucgccggcgccgggcugcuguucagcaucaugaagaacaccgcgaacacccggcgcggcacggggaacaccggcgagacccucggcgagaaguggaagaaccggcugaacgcccuggggaaguccgaguuccagaucuacaagaaguccggcauccaggagguggaccgcacccucgccaaggaggggaucaagcggggcgagacggaccaccacgccgucucccgcgggagcgcgaagcugcggugguucguggagcgcaaccuggugacccccgagggcaaggucguggaccucggcugcgggcggggcgggugguccuacuacugcggcgggcugaagaacgugaaggaggucaagggccugaccaagggcgggcccggccacgaggagcccaucccgaugagcaccuacggguggaaccucgugcgccugcaguccggcguggacgucuucuucacgccgcccgagaagugcgacacccugcucugcgacaucggggagagcagccccaacccgaccguggaggccggccggacccugcgcgugcugaaccucgucgagaacuggcugaacaacaacacccaguucugcaucaaggugcugaaccccuacaugcccuccgugaucgagaagauggaggcccugcagcggaaguacggcggggcccucguccgcaacccgcugagccggaacuccacgcacgagauguacugggugagcaacgccuccggcaacaucgugagcuccgucaacaugaucagccgcaugcugaucaaccgguucaccaugcgccacaagaaggcgaccuacgagcccgacguggaccucggguccggcacccggaacaucgggaucgagagcgagacgcccaaccuggacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgucgugcgccugcucaccaagccgugggacgugauccccauggucacccagauggccaugaccgacacgacccccuucgggcagcagcggguguucaaggagaaggucgacacccgcacccaggagcccaaggagggcacgaagaagcugaugaagaucaccgccgaguggcuguggaaggagcucggcaagaagaagaccccgcggaugugcacccgcgaggaguucacgcggaaggugcgcagcaacgcggcccugggggccaucuucaccgacgagaacaaguggaaguccgcccgggaggccguggaggacagcggcuucugggagcuggucgacaaggagcgcaaccuccaccuggaggggaagugcgagaccugcguguacaacaugaugggcaagcgggagaagaagcugggggaguucggcaaggcgaagggcucccgcgccaucugguacauguggcucggggcccgguuccuggaguucgaggcccugggcuuccucaacgaggaccacugguucagccgcgagaacagccuguccgggguggagggcgaggggcugcacaagcucggcuacauccugcgggacgucagcaagaaggagggcggggcgauguacgccgacgacaccgccggcugggacacgcgcaucacccuggaggaccucaagaacgaggagauggugaccaaccacauggagggggagcacaagaagcuggccgaggccaucuucaagcugaccuaccagaacaaggugguccgggugcagcgccccacgccccggggcaccgugauggacaucaucucccgccgggaccagcgcgggagcggccaggucgugaccuacggccucaacaccuucacgaacauggaggcgcagcugauccggcagauggagggggagggcguguucaaguccauccagcagcugaccgucaaggaggagaucgccgugaagaacuggcucauccgcguggggcgcgagcggcugagccgcauggccaucuccggcgacgacugcgucgugaagccccuggacgaccgguucgccagcgcccucaccgcgcugaacgacaugggcaaggugcgcaaggacauccagcagugggagccgucccggggguggaacgacuggacccagguccccuucugcagccaccacuuccacgagcugaucaugaaggacggccgcgugcucgugguccccugccggaaccaggacgagcugaucgggcgcgcccggaucucccagggcgccggguggagccugcgcgagacggccugccucggcaaguccuacgcccagauguggagccugauguacuuccaccggcgcgaccugcggcucgcggccaacgccaucugcuccgccgugcccagccacugggugccgaccucccgcaccaccuggagcauccacgccacccacgaguggaugacgaccgaggacaugcugaccgucuggaaccggguguggauccaggagaaccccuggauggaggacaagacccccguggagagcugggaggagauccccuaccugggcaagcgcgaggaccaguggugcgggucccucaucggccugacgagccgggcgaccugggccaagaacauccagaccgccaucaaccagguccgcucccugaucggguacgaggaguacaccgacuacaugccgagcaugaagcgguuccgccgcgaggaggaggaggccggcgugcucugguga

SEQ ID NO: 9719 - RNA, 9876 nt, Artificial Sequence
  derived and/or modified CDS sequence (opt1) from DENV-2__JN851127__SS-prME
accgccggcaucaucaucaugaugauccccaccgugauggccuuccaccugaccacccggaacggggagccccacaugaucgucagccggcaggagaagggcaagucccuccuguucaagaccgagaacggggugaacaugugcacccugauggcgauggaccucggcgagcugugcgaggacaccaucaccuacaacugcccccugcucaagcagaacgagcccgaggacaucgacugcuggugcaacagcaccuccaccugggugaccuacgggaccugcaccgccaccggcgagcaccgccgggagaagcgcagcgucgcccuggugccccacgugggcauggggcuggagacccggaccgagaccuggauguccagcgagggcgccuggaagcacgcccagcgcaucgagaccuggguccuccggcaccccggguucaccaucauggcggccauccuggccuacaccaucggcaccaccuacuuccagcgcgugcugaucuucauccuccugaccgccguggcgcccuccaugaccaugcggugcaucgggaucagcaaccgcgacuucgucgagggcguguccggcgggagcuggguggacaucguccuggagcacggcuccugcgugaccaccauggccaagaacaagcccacgcucgacuucgagcugaucaagaccgaggccaagcaccccgccacccugcggaaguacugcaucgaggccaagcucaccaacacgaccaccgcgagccgcugcccgacccagggggagcccucccugagcgaggagcaggacaagcgguucgugugcaagcacuccauggucgaccgcggcuggggcaacgggugcggccuguucgggaagggcgggaucgugacgugcgccauguucacgugcaagaagaacauggagggcaagaucgugcagcccgagaaccucgaguacaccaucgucaucacgccccacagcggcgaggagaacgccguggggaacgacacgggcaagcacgggaaggagaucaaggugaccccgcaguccagcaucaccgaggccgagcugaccggcuacgggaccgucacgauggagugcagcccccggaccggccuggacuucaacgagauggugcuccugcagauggagaacaaggccuggcuggugcaccgccagugguuccucgaccugccccugcccuggcucccgggcgcggacacccaggggagcaacuggauccagaaggagacccuggucacguucaagaacccccacgccaagaagcaggacguggucgugcugggcagccaggagggggccaugcacaccgcccucaccggcgccaccgagauccagauguccagcgggaaccugcuguucacgggccaccucaagugccggcugcgcauggacaagcugcagcucaagggcauguccuacagcaugugcaccgggaaguucaagguggucaaggagaucgcggagacccagcacggcaccaucgugauccgggugcaguacgagggggacggcucccccugcaagauccccuucgagaucauggaccuggagaagcgccacguccugggccggcucaucacggugaacccgaucgugaccgagaaggacagccccgucaacaucgaggccgagccgcccuucggggacuccuacaucaucaucggcguggagccggggcagcugaagcugagcugguucaagaagggcuccagcaucgggcagauguucgagaccaccaugcgcggcgccaagcgcauggccauccucggcgacacggccugggacuucgggucccugggcgggguguucaccagcaucggcaaggcgcugcaccaggucuucggggccaucuacggcgccgccuucuccggcgugagcuggaccaugaagauccucaucgggguggucaucaccuggaucggcaugaacucccggagcacgucccugagcgugucccuggugcuggucgggguggugacccucuaccugggcgucauggugcaggcggacagcgggugcguggucagcuggaagaacaaggagcugaagugcggcuccggcaucuucaucaccgacaacgugcacaccuggacggagcaguacaaguuccagcccgagagccccuccaagcucgccagcgccauccagaaggcccacgaggaggggaucugcggcauccgcuccgugacccggcuggagaaccugauguggaagcagaucacccccgagcucaaccacauccugagcgagaacgagaucaagcugaccaucaugacgggggacaucaagggcaucaugcaggccgggaagcgcucccuccggccgcagcccaucgagcugaaguacagcuggaaggcguggggcaaggccaagaugcuguccaccgagcuccacaaccacaccuuccugaucgacggccccgagaccgccgagugcccgaacacgaaccgcgccuggaacagccuggaggucgaggacuacggguucggcguguucaccaccaacaucuggcucaagcugaaggagcggcaggacguguucugcgacuccaagcugaugagcgccgucaucaaggacaaccgcgcggugcacgccgacaugggguacuggaucgaguccgcccucaacgacaccuggaagaucgagaaggccagcuucaucgaggugaaguccugccacuggcccaagagccacacgcugugguccaacggcguccuggagagcgagaugaucauccccaagaacuucgccggccccgugagccagcacaacuaccggccgggguaccacacccagaccgcgggccccuggcaccucgggcgccuggagauggacuucgacuucugcgagggcaccaccguggucgugacggaggacugcgggaaccggggccccucccugcgcaccaccaccgccagcggcaagcucaucacggaguggugcugccgguccugcacccugcccccgcugcgcuaccgcggggaggacggcugcugguacgggauggagauccgcccccucaaggagaaggaggagaaccuggugaacagccuggucaccgccggccacgggcagaucgacaacuucucccucggcgugcugggcauggcccuguuccucgaggagaugcugcggacccgcguggggacgaagcacgcgauccugcucgucgccgugagcuucgugacccugaucaccggcaacauguccuuccgggaccuggggcgcgucauggugauggugggcgccaccaugacggacgacaucgggaugggcgucaccuaccucgcccugcuggccgcguucaaggugcgccccaccuucgccgccggccuccugcugcggaagcucaccagcaaggagcugaugaugacgaccaucgggaucgugcugcucucccagagcaccauccccgagaccauccuggagcugacggacgcccucgcccugggcaugaugguccugaagaucgugcgcaacauggagaaguaccagcucgcggucaccaucauggccauccugugcgugccgaacgccgugauccugcagaacgccuggaaggucuccugcaccacccucgccguggugagcgucagcccccugcugcucacgagcucccggcagaaggcggacuggaucccccuggcccugaccaucaaggggcucaaccccaccgccaucuuccugaccacgcugagccgcaccuccaagaagcggagcuggccgcucaacgaggccaucauggcggugggcaugguguccauccuggccagcagccugcucaagaacgacauccccaugaccggcccccuggucgccgggggccugcucaccgugugcuacgugcugacggggcgcuccgccgaccuggagcucgagcgggccgcggacguccgcugggaggagcaggccgagaucagcggcuccagccccauccuguccaucaccaucagcgaggacggguccaugagcaucaagaacgaggaggaggagcagacccugaccauccucauccggacgggccugcuggugaucuccggccucuucccggugagcauccccaucaccgccgccgccugguaccugugggaggucaagaagcagcgcgcgggggugcugugggacgugcccagcccgccgcccgucggcaaggccgagcucgaggacggggccuaccggaucaagcagaagggcauccugggguacagccagaucggcgccggcguguacaaggaggggaccuuccacaccauguggcacgugacccgcggcgccguccugaugcacaaggggaagcggaucgagcccuccugggcggacgugaagaaggaccucaucagcuacggcgggggcuggaagcuggagggcgaguggaaggagggggaggaggugcagguccuggcccucgagcccggcaagaacccccgcgccgugcagacgaagcccgggcuguucaagaccaacaccggcaccaucggggccgugucccuggacuucagccccggcacguccggcagccccaucgucgacaagaaggggaagguggugggccucuacgggaacggcgucgugacccgguccggcaccuacgugagcgccaucgcgcagaccgagaaguccaucgaggacaaccccgagaucgaggacgacaucuuccgcaagaagcggcugacgaucauggaccugcaccccggggccggcaagaccaagcgcuaccugcccgccaucguccgggaggccaucaagcgcgggcuccggacccugauccuggcgccgacccgcgugguggccgccgagauggaggaggcccuccgcggccugcccauccgguaccagacgcccgccauccgcgcggagcacaccgggcgggagaucgucgaccugaugugccacgccaccuucaccaugcgccuccugucccccauccgggugccgaacuacaaccugaucaucauggacgaggcccacuucacggaccccgccagcaucgccgcgcgcggcuacaucuccacccggguggagaugggcgaggccgccgggaucuucaugaccgccacgccgcccggcagccgcgacccguucccccaguccaacgcccccaucauggacgaggagcgggagauccccgagcgcagcuggaacuccgggcacgagugggucacggacuucaagggcaagaccgugugguucgugccgagcaucaaggcggggaacgacaucgccgccugccuccggaagaacggcaagaaggucauccagcugucccgcaagaccuucgacagcgaguacaucaagacccggacgaacgacugggacuucguggugaccaccgacaucuccgagaugggcgccaacuucaaggcggagcgcgucaucgacccccggcgcugcaugaagcccgugauccugaccgacggggaggagcgggugauccucgccggccccaugccggucacgcacagcuccgccgcccagcgccgggggcgcgugggccgcaaccccaagaacgagaacgaccaguacaucuacaugggggagccccuggagaacgacgaggacugcgcccacuggaaggaggcgaagaugcugcucgacaacaucaacacccccgagggcaucaucccgagcauguucgagcccgagcgggagaagguggacgccaucgacggcgaguaccgccugcgcggggaggcccgcaagaccuucgucgaccugaugcggcgcggcgaccuccccguguggcuggccuaccgggucgccgcggaggggaucaacuacgccgaccgccgguggugcuucgacggcgugaagaacaaccagauccuggaggagaacguggaggucgagaucuggaccaaggagggggagcgcaagaagcucaagccgcgguggcuggacgcccgcaucuacuccgacccccuggcccucaaggaguucaaggaguucgccgcgggccggaagucccugacgcugaaccucaucaccgagaugggccgccugcccaccuucaugacccagaaggcccggaacgcccuggacaaccucgccgugcugcacacggcggaggccgggggccgcgccuacaaccacgcccuguccgagcuccccgagacccuggagacccugcuccugcugacccuccuggccacggugaccgggggcaucuuccuguuccucaugagcggcaaggggaucggcaagaugacccuggggaugugcugcaucaucaccgcguccauccugcucugguacgcccagauccagccgcacuggaucgccgccagcaucauccuggaguucuuccugaucguccuccugauccccgagcccgagaagcagcggacgccccaggacaaccagcugacguacguggugaucgccauccucaccgucguggcggccaccauggccaacgagaugggcuuccuggagaagaccaagaaggacuucgggcugggcagcaucacgacccagcagccggaguccaacauccucgacaucgaccugcgccccgccagcgccuggacccuguacgcgguggccaccacguucaucacccccaugcuccggcacuccaucgagaacagcuccgucaacgugagccugaccgccaucgccaaccaggccaccgugcugaugggccucgggaagggcuggccccuguccaagauggacaucggggucccgcugcucgcgaucggcugcuacagccaggugaaccccaucacgcugaccgccgcccugcuccugcugguggcccacuacgcgaucaucgggcccggccuccaggccaaggccacccgcgaggcccagaagcgggccgcggccggcaucaugaagaaccccaccgucgacgggaucacggugaucgaccuggacccgauccccuacgaccccaaguucgagaagcagcugggccaggugaugcuccugguccugugcgugacccaggugcucaugaugcgcaccaccugggcccugugcgaggcccugacgcucgccaccgggcccaucuccacccugugggagggcaacccggggcgcuucuggaacaccacgaucgcggucagcauggccaacaucuuccggggcuccuaccuggccggcgccgggcuccuguucagcaucaugaagaacaccgccaacacccgccggggcaccgggaacacgggcgagacccugggcgagaaguggaagaaccgccucaacgcgcuggggaaguccgaguuccagaucuacaagaaguccggcauccaggagguggaccggacccuggccaaggaggggaucaagcgcggcgagaccgaccaccacgccgugucccgggggagcgccaagcuccgcugguucaucgagcggaaccuggucacgcccgagggcaaggugguggaccugggcugcgggcgcggcgggugguccuacuacugcggcgggcucaagaacgucaaggaggugaagggccugaccaagggcgggcccggccacgaggagcccaucccgaugagcaccuacggguggaaccuggugcggcuccaguccggcgucgacguguucuucacgccgcccgagaagugcgacacgcugcugugcgacaucggggagagcagccccaacccgaccguggaggcgggccgcacccuccggguccugaaccugguggagaacuggcucaacaacaacacccaguucugcaucaaggugcugaaccccuacaugcccuccgucaucgagaagauggaggcccugcagcgcaaguacggcggggcccuggugcggaacccgcucagccgcaacuccacccacgagauguacugggugagcaacgccuccggcaacaucgucagcuccgugaacaugaucagccggaugcugaucaaccgcuucacgaugcggcacaagaaggccaccuacgagcccgacguggaccugggguccggcacccgcaacaucgggaucgagagcgagacccccaaccucgacaucaucggcaagcgcaucgagaagaucaagcaggagcacgagacguccuggcacuacgaccaggaccaccccuacaagaccugggcguaccacggcagcuacgagaccaagcagaccggguccgccagcuccauggucaacggcguggugcggcugcugacgaagccgugggacgucauccccauggugacccagauggccaugaccgacaccacgcccuucgggcagcagcgcguguucaaggagaaggucgacacccggacccaggagcccaaggagggcaccaagaagcucaugaagaucacggccgaguggcuguggaaggagcugggcaagcgcaagaccccgcggaugugcacccgcgaggaguucacccggaaggugcgcagcaacgccgcgcucggggccaucuucacggacgagaacaaguggaaguccgcccgggaggccgucgaggacagcggcuucugggagcugguggacaaggagcgcaaccugcaccucgaggggaagugcgagaccugcguguacaacaugaugggcaagcgggagaagaagcugggggaguucggcaaggccaagggcucccgcgcgaucugguacauguggcugggggcccgguuccucgaguucgaggcccugggcuuccugaacgaggaccacugguucagccgcgagaacagccucuccggggucgagggcgaggggcugcacaagcugggcuacauccuccgggacgugagcaagaaggagggcggggccauguacgcggacgacaccgccggcugggacacccgcaucacgcuggaggaccugaagaacgaggagauggugaccaaccacauggaggggguccacaagaagcucgccgaggccaucuuccggcugaccuaccagaacaagguggugcgcguccagcggcccacgccccggggcacggugauggacaucaucucccggcgcgaccagcgcgggagcggccagguggucaccuacggccugaacaccuucaccaacauggaggcccagcucauccggcagauggagggggagggcguguucaaguccauccagcaccugacggugaccgaggagaucgcggucaagaacuggcuggugcgcguggggcgggagcgccucagccggauggccaucuccggcgacgacugcgucgugaagccccuggacgaccgcuucgccagcgcccugaccgcccucaacgacaugggcaaggugcggaaggacauccagcagugggagccgucccgcggguggaacgacuggacccagguccccuucugcagccaccacuuccacgagcugaucaugaaggacggccgggugcuggugguccccugccgcaaccaggacgagcucaucgggcgggcgcgcaucucccagggcgccggguggagccugcgggagacggccugccugggcaaguccuacgcccagauguggagccucauguacuuccaccgccgggaccugcgccuggccgcgaacgccaucugcuccgccgugcccagccacugggugccgaccucccggaccaccuggagcauccacgccacccacgaguggaugacgaccgaggacaugcucaccgucuggaaccgcguguggauccaggagaaccccuggauggaggacaagacccccaucgagagcugggaggagauccccuaccugggcaagcgggaggaccaguggugcgggucccugaucggccucacgagccgcgccaccugggcgaagaacauccagaccgccaucaaccaggugcgcucccugaucgggaacgaggaguacaccgacuacaugccgagcaugaagcgguuccgccgggaggaggaggaggccggcguccugugguga

SEQ ID NO: 9720 - RNA, 9876 nt, Artificial Sequence
  derived and/or modified CDS sequence (opt1) from DENV-2__JN851120__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggauccuccgccaccccggguucacgaucauggcggccauccuggccuacaccgucggcaccaccuacuuccagcgggugcugaucuucauccuccugacggccgugacccccuccauggcgaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgucugcaagcacagcaugguggaccggggcuggggcaacgggugcggccuguucgggaagggcgggaucgugacgugcgccauguucacgugcaagaagaacauggagggcaaggucgugcagcccgagaaccucgaguacaccaucgugaucacgccccacuccggcgaggagaacgccgucgggaacgacacgggcaagcacgggaaggagaucaaggugaccccgcagagcuccaucaccgaggccgagcugaccggcuacgggaccgugacgauggagugcagcccccgcaccggccuggacuucaacgagaugguccuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggugguccugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggugaaggagaucgcggagacccagcacggcaccaucgucauccgcgugcaguacgagggggacggcagccccugcaagauccccuucgagaucauggaccuggagaagcggcacgugcugggccgccucaucacggucaacccgaucgugaccgagaaggacucccccgugaacaucgaggccgagccgcccuucggggacagcuacaucaucaucggcgucgagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccagguguucggggccaucuacggcgccgccuucagcggcgucuccuggaccaugaagauccucaucgggguggugaucaccuggaucggcaugaacagccgcuccacgagccuguccgucagccuggugcuggugggggucgugacccucuaccugggcgugaugguccaggcggacuccgggugcguggugagcuggaagaacaaggagcugaagugcggcagcggcaucuucaucaccgacaacguccacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccugaccgagaacgaggugaagcugacgaucaugaccggggacaucaagggcaucaugcaggccgggaagcggucccuccgcccgcagcccaccgagcugaaguacagcuggaaggcguggggcaaggccaagaugcuguccaccgagcuccacaaccacacguuccugaucgacggccccgagaccgccgagugcccgaacaccaaccgggccuggaacagccuggaggucgaggacuacggguucggcguguucaccacgaacaucuggcucaagcugaaggagcgccaggacguguucugcgacuccaagcugaugagcgccgcgaucaaggacaaccgggccguccacgccgacaugggguacuggaucgaguccgcccucaacgacaccuggaagaucgagaaggccagcuucaucgaggugaaguccugccacuggcccaagagccacacccugugguccaacggcgugcuggagagcgagaugaucauccccaagaacuucgcgggccccgucucccagcacaacuaccgcccgggguaccacacccagaccgccggccccuggcaccucgggcggcuggagauggacuucgacuucugcgagggcacgaccgugguggucaccgaggacugcgggaaccgcggccccagccugcggaccacgaccgccagcggcaagcucaucaccgaguggugcugccgcuccugcacccugcccccgcugcgguaccgcggggaggacggcugcugguacgggauggagauccggccccucaaggagaaggaggagaaccuggugaacagccuggugacggccggccacgggcagaucgacaacuucucccucggcguccugggcauggcgcuguuccucgaggagaugcugcgcacccggguggggaccaagcacgccauccugcucguggccgucagcuucgugacccugaucacgggcaacauguccuuccgcgaccuggggcgcgugauggucauggugggcgccaccaugaccgacgacaucgggaugggcgugaccuaccucgcccugcuggcggccuucaagguccggcccacguucgccgccggccuccugcugcgcaagcucaccagcaaggagcugaugaugaccaccaucgggaucgugcugcucucccagagcacgauccccgaguccauccuggagcugaccgacgcccucgcgcugggcaugaugguccugaagaucgugcggaacauggagaaguaccagcucgccgugaccaucauggccauccugugcgucccgaacgccgugauccugcagaacgccuggaaggugagcugcaccacgcucgcggucguguccgugagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgucggcauggugagcauccuggccuccagccugcucaagaacgacauccccaugaccggcccccugguggccgggggccugcucacggucugcuacgugcugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugacgauccucauccggaccggccugcuggucaucagcggccucuucccgguguccauccccaucaccgccgccgcgugguaccugugggaggugaagaagcagcgcgccgggguccugugggacgugcccagcccgccgcccgugggcaaggccgagcucgaggacggggccuaccggaucaagcagaagggcauccugggguacucccagaucggcgccggcgucuacaaggaggggaccuuccacaccauguggcacgugacgcgcggcgcggugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagaccaacaccggcacgaucggggccgugagccuggacuucucccccggcaccagcggcucccccaucguggacaagaaggggaaggucgugggccucuacgggaacggcguggucacccggagcggcaccuacguguccgcgaucgcccagacggagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcgucguggccgccgagauggaggaggcccuccgcggccugcccauccgguaccagacccccgcgauccgcgccgagcacaccgggcgggagaucguggaccugaugugccacgccaccuucacgaugcgccuccugagccccauccgggucccgaacuacaaccugaucaucauggacgaggcccacuucaccgaccccgccuccaucgcggcccgcggcuacaucagcacccggguggagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugaccgacuucaagggcaagaccgucugguucgugccguccaucaaggccgggaacgacaucgccgccugccuccggaagaacggcaagaaggugauccagcugagccgcaagaccuucgacuccgaguacaucaagacgcggaccaacgacugggacuucgucgugaccaccgacaucagcgagaugggcgcgaacuucaaggccgagcgcgugaucgacccccggcgcugcaugaagcccgucauccugacggacggggaggagcgggugauccucgccggccccaugccggugacccacuccagcgccgcccagcgccgggggcgcgucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgggagaagguggacgccaucgacggcgaguaccgccugcgcggggaggcccgcaagaccuucgucgaccugaugcggcgcggcgaccuccccguguggcuggccuaccggguggcggccgaggggaucaacuacgccgaccgccgguggugcuucgacggcgucaagaacaaccagauccuggaggagaacguggagguggagaucuggacgaaggagggggagcgcaagaagcucaagccgcgguggcuggacgcccgcaucuacagcgacccccuggcccucaaggaguucaaggaguucgcggccggccggaagucccugacccugaaccucaucaccgagaugggccgccugcccaccuucaugacgcagaaggccaagaacgcccuggacaaccucgcgguccugcacaccgccgaggccgggggccgggccuacaaccacgcccugagcgagcuccccgagacccuggagacccugcuccugcugacgcuccuggcgaccgugaccgggggcaucuuccuguuccucauguccggcaaggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugaccuacgucgugaucgcgauccucaccguggucgccgccaccauggccaacgagaugggcuuccuggagaagacgaagaaggacuucgggcugggcagcaucaccacccagcagccggagagcaacauccucgacaucgaccugcggcccgccuccgcguggacccuguacgccguggccacgaccuucaucacccccaugcuccgccacagcaucgagaacuccagcgugaacgucucccugaccgccaucgccaaccaggcgacggugcugaugggccucgggaagggcuggccccugagcaagauggacaucggggugccgcugcucgccaucggcugcuacucccaggucaaccccaucacccugaccgccgcccugcuccugcugguggcgcacuacgccaucaucgggcccggccuccaggccaaggccacccgggaggcccagaagcgcgcggccgccggcaucaugaagaaccccacgguggacgggaugaccgucaucgaccuggacccgauccccuacgaccccaaguucgagaagcagcugggccaggugaugcuccuggugcugugcgucacccaggugcucaugaugcggaccacgugggcccugugcgaggcccugacccucgcgaccgggcccaucagcacccugugggagggcaacccggggcgcuucuggaacacgaccaucgccguguccauggccaacaucuuccgcggcagcuaccuggccggcgccgggcuccuguucuccaucaugaagaacaccgcgaacacccggcgcggcacggggaacaccggcgagacccugggcgagaaguggaagaaccggcucaacgcccugggcaagagcgaguuccagaucuacaagaaguccggcauccaggaggucgaccgcacccuggccaaggaggggaucaagcggggcgagacggaccaccacgccgugagccgcggguccgcgaagcuccggugguucguggagcgcaaccuggucacccccgagggcaaggugguggaccugggcugcgggcggggcggguggagcuacuacugcggcgggcucaagaacgucaaggaggugaagggccugaccaagggcgggcccggccacgaggagcccaucccgauguccaccuacggguggaaccuggugcgccuccagagcggcgucgacguguucuucacgccgcccgagaagugcgacacccugcugugcgacaucggggaguccagccccaacccgaccguggaggccggccggacccuccgcguccugaaccugguggagaacuggcucaacaacaacacccaguucugcaucaaggugcugaaccccuacaugcccagcgucaucgagaagauggaggcccugcagcggaaguacggcggggcccuggugcgcaacccgcucucccggaacagcacgcacgagauguacuggguguccaacgccagcggcaacaucgucuccagcgugaacaugaucucccgcaugcugaucaaccgguucaccaugcgccacaagaaggcgaccuacgagcccgacguggaccuggggagcggcacccggaacaucgggaucgaguccgagacgcccaaccucgacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggucaacggcguggugcgccugcugaccaagccgugggacgucauccccauggugacccagauggccaugaccgacacgacccccuucgggcagcagcgggucuucaaggagaagguggacacccgcacccaggagcccaaggagggcacgaagaagcucaugaagaucaccgccgaguggcuguggaaggagcugggcaagaagaagaccccgcggaugugcacccgcgaggaguucacgcggaaggugcgcuccaacgcggcccucggggccaucuucaccgacgagaacaaguggaaguccgcccgggaggccgucgaggacuccggcuucugggagcugguggacaaggagcgcaaccugcaccucgaggggaagugcgagaccugcguguacaacaugaugggcaagcgggagaagaagcugggggaguucggcaaggcgaagggcagccgcgccaucugguacauguggcugggggcccgguuccucgaguucgaggcccugggcuuccugaacgaggaccacugguucucccgcgagaacagccucagcggggucgagggcgaggggcugcacaagcugggcuacauccuccgggacguguccaagaaggagggcggggcgauguacgccgacgacaccgccggcugggacacgcgcaucacccuggaggaccugaagaacgaggagauggugaccaaccacauggagggggagcacaagaagcucgccgaggccaucuucaagcugaccuaccagaacaaggucgugcgggugcagcgccccacgccccggggcaccgucauggacaucaucagccgccgggaccagcgcggguccggccagguggugaccuacggccugaacaccuucacgaacauggaggcgcagcucauccggcagauggagggggagggcgucuucaagagcauccagcagcugaccgugaaggaggagaucgccgugaagaacuggcugauccgcgucgggcgcgagcggcucucccgcauggccaucagcggcgacgacugcguggugaagccccuggacgaccgguucgccuccgcccugaccgcgcucaacgacaugggcaagguccgcaaggacauccagcagugggagccgagccggggguggaacgacuggacccaggugcccuucugcucccaccacuuccacgagcugaucaugaaggacggccgcgugcuggucgugcccugccggaaccaggacgagcucaucgggcgcgcccggaucagccagggcgccggguggucccugcgcgagacggccugccugggcaagagcuacgcccagauguggucccucauguacuuccaccggcgcgaccugcggcuggcggccaacgccaucugcagcgccgugcccucccacugggucccgaccagccgcaccaccugguccauccacgccacccacgaguggaugacgaccgaggacaugcucaccguguggaaccggguguggauccaggagaaccccuggauggaggacaagacccccgucgagagcugggaggagauccccuaccugggcaagcgcgaggaccaguggugcgggagccugaucggccucacgucccgggcgaccugggccaagaacauccagaccgccaucaaccaggugcgcagccugaucgggaacgaggaguacaccgacuacaugccguccaugaagcgguuccgcaucgaggaggaggaggccggcgugcugugguga

SEQ ID NO: 9721 - RNA, 9876 nt, Artificial Sequence
  derived and/or modified CDS sequence (opt1) from DENV-2__JN851131__SS-prME
accgcgggcgugaucaucaugaugauccccaccgugauggccuuccaccugaccacccggaacggggagccccacaugaucgugagccggcaggagaagggcaagucccuccuguucaagaccgagaacggggugaacaugugcacccugauggcgaucgaccucggcgagcugugcgaggacaccaucaccuacaacugcccccugcuccgccagaacgagcccgaggacaucgacugcuggugcaacagcaccuccaccugggucaccuacgggaccugcaccgccaccggcgagcaccggcgcgagaagcggagcguggcccuggugccccacgucggcauggggcuggagacccgcaccgagaccuggauguccagcgagggcgccuggaagcacgcccagcggaucgagaccugggugcuccgccaccccggguucaccaucauggcggccauccuggccuacaccaucggcaccaccuacuuccagcgggugcugaucuucauccuccugaccgccgucgcgcccuccaugaccaugcgcugcaucgggaucagcaaccgggacuucguggagggcguguccggcgggagcugggucgacaucgugcuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaaggaggagcaggacaagcgcuucgucugcaagcacagcaugguggaccggggcuggggcaacgggugcggccuguucgggaagggcgggaucgugacgugcgccauguucacgugcaagaagaacauggagggcaaggucgugcagcccgagaaccucgaguacaccaucgugaucacgccccacuccggcgaggagaacgccgucgggaacgacacgggcaagcacgggaaggagaucaaggugaccccgcagagcuccaucaccgaggccgagcugaccggcuacgggaccgugacgauggagugcagcccccgcaccggccuggacuucaacgagaugguccuccugcagauggaggacaaggccuggcuggugcaccggcagugguuccucgaccugccccugcccuggcucccgggcgcggacacccagggguccaacuggauccagaaggagacccuggucacguucaagaacccccacgccaagaagcaggacguggugguccugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggugaaggagaucgcggagacccagcacggcaccaucgucauccgcgugcaguacgagggggacggcagccccugcaagauccccuucgagaucauggaccuggagaagcggcacgugcugggccgccucaucacggucaacccgaucgugaccgagaaggacucccccgugaacaucgaggccgagccgcccuucggggacagcuacaucaucaucggcgucgagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccagguguucggggccaucuacggcgccgccuucagcggcgucuccuggaccaugaagauccucaucgggguggugaucaccuggaucggcaugaacagccgcuccacgagccuguccgucagccuggugcuggugggggucgugacccucuaccugggcgugaugguccaggcggacuccgggugcguggugagcuggaagaacaaggagcugaagugcggcagcggcaucuucaucaccgacaacguccacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggugaagcugaccaucaugacgggggacaucaagggcaucaugcaggccgggaagcggagccuccgcccgcagcccaccgagcugaaguacuccuggaagaccuggggcaaggcgaagaugcugagcaccgagcuccacaaccacacguuccugaucgacggccccgagaccgccgagugcccgaacaccaaccgggccuggaacucccuggaggucgaggacuacggguucggcguguucaccacgaacaucuggcucaagcugaaggagcgccaggagguguucugcgacagcaagcugauguccgccgccaucaaggacaaccgggcgguccacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgcgggccccuggcaccucgggaagcuggagauggacuucgacuucugcgagggcacgaccgugguggucaccgaggacugcgggaaccggggccccagccugcgcaccacgaccgccuccggcaagcucaucaccgaguggugcugccggagcugcacccugcccccgcugcgcuaccgcggggaggacggcugcugguacgggauggagauccgccccuccaaggagaaggaggagaaccucgugaacagccuggugacggccggccacgggcagaucgacaacuucucccugggcguccucggcauggcccuguuccuggaggagaugcuccggacccgcguggggaccaagcacgcgauccugcugguggccgucagcuucgugacccucaucacgggcaacauguccuuccgggaccuggggcgcgugauggucauggugggcgccaccaugaccgacgacaucgggaugggcgugaccuaccuggcccuccuggccgcguucaagguccgccccacguucgccgccggccugcuccugcggaagcugaccagcaaggagcucaugaugaccaccaucgggaucgugcugcugucccagagcacgauccccgagaccauccucgagcugaccgacgcccuggcccucggcaugaugguccugaagaucgugcgcaacauggagaaguaccagcuggcggugaccaucauggccauccucugcgucccgaacgccgugauccugcagaacgccuggaagguguccugcacgacccuggccgucgugagcgugagcccccugcugcugaccagcucccagcagaaggcggacuggaucccccucgcccugaccaucaaggggcugaaccccacggccaucuuccucaccacccugagccggaccuccaagaagcgcagcuggccgcugaacgaggccaucauggcggucggcaugguguccauccucgccagcagccugcugaagaacgacauccccaugacgggcccccucguggccgggggccugcugaccgucugcuacgugcucaccgggcgguccgccgaccuggagcuggagcgcgccgcggacgugcggugggaggagcaggccgagaucagcggcuccagccccauccucuccaucaccaucagcgaggacggguccaugagcaucaagaacgaggaggaggagcagacgcugaccauccugauccgcaccggccuccuggucaucuccggccuguucccggugagcauccccaucaccgccgccgccugguaccucugggaggugaagaagcagcgggcggggguccugugggacgugcccagcccgccgcccgugggcaaggccgagcuggaggacggggccuaccgcaucaagcagaagggcauccucggguacagccagaucggcgccggcgucuacaaggaggggaccuuccacacgauguggcacgugacccggggcgccgugcugaugcacaaggggaagcgcaucgagcccuccugggcggacgucaagaaggaccugaucagcuacggcgggggcuggaagcucgagggcgaguggaaggagggggaggagguccaggugcuggcccuggagcccggcaagaacccccgggccguccagaccaagcccggccucuucaagaccaacacgggcaccaucggggccgugucccuggacuucagccccggcaccuccggcagccccaucguggacaagaaggggaaggucgugggccuguacgggaacggcguggucacccgcuccggcacguacgugagcgccaucgcgcagaccgagaaguccaucgaggacaaccccgagaucgaggacgacaucuuccggaagaagcgccucaccaucauggaccugcaccccggggccggcaagaccaagcgguaccugcccgccaucgugcgcgaggccaucaagcgggggcugcgcacgcucauccuggcgccgacccgggucguggccgccgagauggaggaggcccugcgcggccuccccauccgcuaccagacccccgccauccggguggagcacaccgggcgcgagaucgucgaccugaugugccacgcgacguucaccaugcggcugcucucccccauccgcgugccgaacuacaaccugaucaucauggacgaggcccacuucaccgaccccgccagcaucgccgcccggggcuacaucuccacccgcguggagaugggcgaggcggccgggaucuucaugacggccacgccgcccggcagccgggacccguucccccaguccaacgcccccaucauggacgaggagcgcgagauccccgagcggagcuggaacuccgggcacgaguggaucaccgacuucaagggcaagaccgucugguucgugccgagcaucaaggccgggaacgacaucgcggccugccugcgcaagaacggcaagaaggugauccagcucucccggaagacguucgacagcgaguacaucaagacccgcaccaacgacugggacuucgucgugaccacggacaucuccgagaugggcgccaacuucaaggccgagcgggugaucgacccccgccggugcaugaagcccgucauccugaccgacggggaggagcgcgugauccuggcgggccccaugccggugacccacagcuccgccgcccagcggcgcgggcgggucggccgcaaccccaagaacgagaacgaccaguacaucuacaugggggagccccucgagaacgacgaggacugcgcccacuggaaggaggccaagaugcugcuggacaacaucaacacccccgagggcaucaucccgagcauguucgagcccgagcgcgagaagguggacgcgaucgacggcgaguaccggcuccgcggggaggcccggaagacguucgucgaccugaugcgccggggcgaccugcccguguggcucgccuaccgcguggccgccgaggggaucaacuacgcggaccggcgcuggugcuucgacggcgucaagaacaaccagauccuggaggagaacguggagguggagaucuggaccaaggagggggagcggaagaagcugaagccgcgcuggcucgacgcccggaucuacuccgacccccuggcccugaaggaguucaaggaguucgccgccggccgcaagagccucacccugaaccugaucaccgagaugggccggcuccccacguucaugacccagaaggcgcgcaacgcccuggacaaccuggccguccuccacaccgccgaggccggcgggcgggccuacaaccacgcccuguccgagcugcccgagacccucgagacgcugcugcuccugacccugcucgccaccgugaccggcgggaucuuccuguuccugaugagcgggaaggggaucggcaagaugacccucgggaugugcugcaucaucacggccuccgugcugcugugguacgcgcagauccagccgcacuggaucgccgccagcaucauccucgaguucuuccugaucguccugcucauccccgagcccgagaagcagcgcacgccccaggacaaccagcugaccuacguggugaucgccauccugaccgucguggccgcgacgauggccaacgagaugggcuuccucgagaagaccaagaaggacuucgggcugggcagcaucgccauccagcagccggaguccaacauccuggacaucgaccuccggcccgccagcgccuggacccuguacgcgguggccaccacguucaucacccccaugcugcgccacuccaucgagaacagcuccgucaacgugagccucaccgccaucgccaaccaggccaccgugcugaugggccuggggaagggcuggccccucuccaagauggacaucggggucccgcugcuggcgaucggcugcuacagccaggugaaccccaucacgcucaccgccgcccugcugcuccugguggcccacuacgcgaucaucgggcccggccugcaggccaaggccacccgggaggcccagaagcgcgccgcggccggcaucaugaagaaccccaccgucgacgggaucacggugaucgaccucgacccgauccccuacgaccccaaguucgagaagcagcugggccaggugaugcugcucguccugugcgugacccaggugcugaugaugcggaccaccugggcccucugcgaggcccugacgcuggccaccgggcccaucuccacccucugggagggcaacccggggcgcuucuggaacaccacgaucgcggucagcauggccaacaucuuccgcggcuccuaccuggccggcgccgggcuccucuucagcaucaugaagaacaccgccaacacccggcgcggcaccgggaacacgggcgagacccugggcgagaaguggaagaaccggcugaacgcgcucgggaaguccgaguuccagaucuacaagaaguccggcauccaggagguggaccgcacccuggccaaggaggggaucaagcggggcgagaccgaccaccacgccgugucccgcgggagcgccaagcugcggugguucgucgagcgcaaccucgugacgcccgagggcaagguggucgaccugggcugcgggcggggcgggugguccuacuacugcggcgggcugaagaacgugaaggaggugaagggccucaccaagggcgggcccggccacgaggagcccaucccgaugagcaccuacggguggaaccugguccgccugcaguccggcguggacguguucuucacgccgcccgagaagugcgacacgcuccugugcgacaucggggagagcagccccaacccgaccgucgaggcgggccggacccugcgcgugcucaaccugguggagaacuggcugaacaacaacacccaguucugcaucaagguccucaaccccuacaugcccuccgugaucgagaagauggaggcccugcagcggaaguacggcggggcccuggugcgcaacccgcugagccggaacuccacccacgagauguacugggucagcaacgccuccggcaacaucgugagcuccgugaacaugaucagccgcaugcucaucaaccgguucacgaugcgccacaagaaggccaccuacgagcccgacgucgaccugggguccggcacccggaacaucgggaucgagagcgagaagcccaaccuggacaucaucggcaagcgcaucgagaagaucaagcaggagcacgagaccuccuggcacuacgaccaggaccaccccuacaagacgugggcguaccacggcagcuacgagaccaagcagaccggguccgccagcuccauggugaacggcgugguccgccuccugaccaagccgugggacgugauccccauggucacgcagauggccaugaccgacaccacccccuucgggcagcagcggguguucaaggagaagguggacacgcgcacccaggagcccaaggagggcaccaagaagcugaugaagaucaccgccgaguggcucuggaaggagcugggcaagaagaagacgccgcggaugugcacccgcgaggaguucacccggaagguccgcagcaacgccgcgcugggggccaucuucaccgacgagaacaaguggaaguccgcccgggaggccguggaggacagcggcuucugggagcucgugaacaaggagcgcaaccugcaccuggaggggaagugcgagacgugcgucuacaacaugaugggcaagcgggagaagaagcucggggaguucggcaaggccaagggcucccgcgcgaucugguacauguggcugggggcccgguuccuggaguucgaggcccucggcuuccugaacgaggaccacugguucagccgcgagaacagccuguccgggguggagggcgaggggcuccacaagcugggcuacauccugcgggacgugagcaagaaggagggcggggccauguacgcggacgacaccgccggcugggacacccgcaucacccucgaggaccugaagaacgaggagauggucacgaaccacauggagggggagcacaagaagcuggccgaggccaucuucaagcucaccuaccagaacaagguggugcggguccagcgccccacgccccggggcaccgugauggacaucaucucccgccgggaccagcgcgggagcggccagguggucacguacggccugaacaccuucaccaacauggaggcccagcugauccggcagauggagggggagggcguguucaaguccauccagcaccucaccgugacggaggagaucgcggucaagaacuggcuggugcgcguggggcgcgagcggcugagccgcauggccaucuccggcgacgacugcgucgugaagccccucgacgaccgguucgccagcgcccugaccgcccugaacgacaugggcaaggugcgcaaggacauccagcagugggagccgucccggggguggaacgacuggacccagguccccuucugcagccaccacuuccacgagcucaucaugaaggacggccgcgugcuggugguccccugccggaaccaggacgagcugaucgggcgcgcgcggaucucccagggcgccggguggagccuccgcgagaccgccugccugggcaaguccuacgcccagauguggagccugauguacuuccaccggcgcgaccuccggcuggccgcgaacgccaucugcuccgccgugcccagccacugggugccgacgucccgcaccaccuggagcauccacgccacccacgaguggaugaccacggaggacaugcugaccgucuggaaccggguguggauccaggagaaccccuggauggaggacaagacccccguggagagcugggaggagauccccuaccucggcaagcgcgaggaccaguggugcgggucccugaucggccugaccagccgggccacgugggcgaagaacauccagaccgccaucaaccagguccgcucccucaucgggaacgaggaguacaccgacuacaugccgagcaugaagcgguuccgccgcgaggaggaggaggccggcgugcugugguga

SEQ ID NO: 9722 - RNA, 9876 nt, Artificial Sequence
  derived and/or modified CDS sequence (opt1) from DENV-2__JN851122__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucaccaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgugauggugcaggcggacuccgggugcgucgugagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgucacccgccuggagaaccugauguggaagcagaucacccccgagcucaaccacauccugaccgagaacgaggugaagcugacgaucaugaccggggacaucaagggcaucaugcaggccgggaagcggucccuccgcccgcagcccaccgagcugaaguacagcuggaaggcguggggcaaggccaagaugcuguccaccgagcuccacaaccacacguuccugaucgacggccccgagaccgccgagugcccgaacaccaaccgggccuggaacagccuggagguggaggacuacggguucggcgucuucaccacgaacaucuggcucaagcugaaggagcgccaggacguguucugcgacuccaagcugaugagcgccgcgaucaaggacaaccgggccgugcacgccgacaugggguacuggaucgaguccgcccucaacgacaccuggaagaucgagaaggccagcuucaucgaggucaaguccugccacuggcccaagagccacacccugugguccaacggcgugcuggagagcgagaugaucauccccaagaacuucgcgggccccgugucccagcacaacuaccgcccgggguaccacacccagaccgccggccccuggcaccucgggcggcuggagauggacuucgacuucugcgagggcacgaccgucguggugaccgaggacugcgggaaccgcggccccagccugcggaccacgaccgccagcggcaagcucaucaccgaguggugcugccgcuccugcacccugcccccgcugcgguaccgcggggaggacggcugcugguacgggauggagauccggccccucaaggagaaggaggagaaccuggucaacagccuggugacggccggccacgggcagaucgacaacuucucccucggcgugcugggcauggcgcuguuccucgaggagaugcugcgcacccgggucgggaccaagcacgccauccugcucguggccgugagcuucgucacccugaucacgggcaacauguccuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccagcaaggagcugaugaugaccaccaucgggaucguccugcucucccagagcacgauccccgaguccauccuggagcugaccgacgcccucgcgcugggcaugauggugcugaagaucguccggaacauggagaaguaccagcucgccgugaccaucauggccauccugugcgugccgaacgccgucauccugcagaacgccuggaaggugagcugcaccacgcucgcgguggucuccgugagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgugggcauggucagcauccuggccuccagccugcucaagaacgacauccccaugaccggcccccugguggccgggggccugcucacggugugcuacguccugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccggucuccauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacucccagaucggcgccggcguguacaaggaggggaccuuccacaccauguggcacgucacgcgcggcgcggugcugaugcacaaggggaagcggaucgagcccagcugggccgacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagaccaacaccggcacgaucggggccgucagccuggacuucucccccggcaccagcggcucccccaucguggacaagaaggggaagguggucggccucuacgggaacggcguggugacccggagcggcaccuacgucuccgcgaucgcccagacggagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcguggucgccgccgagauggaggaggcccuccgcggccugcccauccgguaccagacccccgcgauccgcgccgagcacaccgggcgggagaucguggaccugaugugccacgccaccuucacgaugcgccuccugagccccauccgggugccgaacuacaaccugaucaucauggacgaggcccacuucaccgaccccgccuccaucgcggcccgcggcuacaucagcacccgggucgagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugaccgacuucaagggcaagaccgugugguucgucccguccaucaagaccgggaacgacaucgccgccugccuccggaagaacggcaagaaggugauccagcugagccgcaagacguucgacuccgaguacaucaagacccggaccaacgacugggacuucguggucaccacggacaucagcgagaugggcgccaacuucaaggcggagcgcgugaucgacccccggcgcugcaugaagcccgugauccugaccgacggggaggagcgggucauccucgccggccccaugccggugacccacuccagcgccgcccagcgccgggggcgcgugggccgcaaccccaagaacgagaacgaccaguacaucuacaugggggagccccuggagaacgacgaggacugcgcccacuggaaggaggcgaagaugcugcucgacaacaucaacacccccgagggcaucaucccguccauguucgagcccgagcgggagaaggucgacgccaucgacggcgaguaccgccugcgcggggaggcccgcaagacguucguggaccugaugcggcgcggcgaccuccccgucuggcuggccuaccggguggccgcggaggggaucaacuacgccgaccgccgguggugcuucgacggcgugaagaacaaccagauccuggaggagaacgucgagguggagaucuggaccaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccacguucaugacccagaaggccaagaacgcccuggacaaccucgccgugcugcacaccgcggaggccgggggccgggccuacaaccacgcccugagcgagcuccccgagacccuggagacgcugcuccugcugacccuccuggccaccgucaccgggggcaucuuccuguuccucauguccggcaaggggaucggcaagaugacccuggggaugugcugcaucaucacggcgagcauccugcucugguacgcccagauccagccgcacuggaucgccgccuccaucauccuggaguucuuccugaucgugcuccugauccccgagcccgagaagcagcgcacgccccaggacaaccagcugaccuacguggucaucgccauccucaccgugguggcggccacgauggccaacgagaugggcuuccuggagaagaccaagaaggacuucgggcugggcagcaucaccacccagcagccggagagcaacauccucgacaucgaccugcggcccgccuccgccuggacgcuguacgcggucgccaccaccuucaucacccccaugcuccgccacagcaucgagaacuccagcgugaacgugucccugacggccaucgccaaccaggccaccguccugaugggccucgggaagggcuggccccugagcaagauggacaucggggugccgcugcucgcgaucggcugcuacucccaggugaaccccaucacccugaccgccgcccugcuccugcuggucacgcacuacgccaucaucgggcccggccuccaggcgaaggccacccgggaggcccagaagcgcgccgccgcgggcaucaugaagaaccccaccguggacgggaugaccgugaucgaccuggacccgauccccuacgaccccaaguucgagaagcagcugggccaggucaugcuccuggugcugugcgugacgcagguccucaugaugcggaccaccugggcccugugcgaggcccugacccucgccacggggcccaucagcacccugugggagggcaacccggggcgcuucuggaacaccaccaucgccguguccauggcgaacaucuuccgcggcagcuaccuggccggcgccgggcuccuguucuccaucaugaagaacacggccaacacccggcgcggcaccgggaacaucggcgagacccugggcgagaaguggaagaaccggcucaacgcccugggcaagagcgaguuccagaucuacaagaaguccggcauccaggagguggaccgcacgcuggcgaaggaggggaucaagcggggcgagaccgaccaccacgccgucagccgcggguccgccaagcuccggugguucguggagcgcaaccuggugacccccgagggcaaggucguggaccugggcugcgggcggggcggguggagcuacuacugcggcgggcucaagaacgugaaggaggucaagggccugaccaagggcgggcccggccacgaggagcccaucccgauguccacguacggguggaaccuggugcgccuccagagcggcguggacgucuucuucacgccgcccgagaagugcgacacccugcugugcgacaucggggaguccagccccaacccgaccguggaggccggccggacccuccgcgugcugaaccuggucgagaacuggcucaacaacaacacgcaguucugcaucaaggugcugaaccccuacaugcccagcgugaucgagaagauggaggcgcugcagcggaaguacggcggggcccugguccgcaacccgcucucccggaacagcacccacgagauguacuggguguccaacgccagcggcaacaucguguccagcgucaacaugaucucccgcaugcugaucaaccgguucaccaugcgccacaagaaggccaccuacgagcccgacguggaccuggggagcggcacgcggaacaucgggaucgaguccgagacccccaaccucgacaucaucggcaagcgcaucgagaagaucaagcaggagcacgagaccagcuggcacuacgaccaggaccaccccuacaagaccugggccuaccacggcuccuacgagacgaagcagaccgggagcgcguccagcauggugaacggcgucgugcgccugcugaccaagccgugggacgugauccccauggucacccagauggccaugacggacaccacccccuucgggcagcagcggguguucaaggagaaggucgacacccgcacgcaggagcccaaggagggcaccaagaagcucaugaagaucaccgccgaguggcuguggaaggagcugggcaagaagaagaccccgcggaugugcacgcgcgaggaguucacccggaaggugcgcuccaacgccgcccucggggcgaucuucaccgacgagaacaaguggaaguccgcccgggaggccguggaggacuccggcuucugggagcuggucgacaaggagcgcaaccugcaccucgaggggaagugcgagaccugcguguacaacaugaugggcaagcgggagaagaagcugggggaguucggcaaggccaagggcagccgcgccaucugguacauguggcugggggcgcgguuccucgaguucgaggcccugggcuuccugaacgaggaccacugguucucccgcgagaacagccucagcgggguggagggcgaggggcugcacaagcugggcuacauccuccgggacgucuccaagaaggagggcggggccauguacgccgacgacacggcgggcugggacacccgcaucacccuggaggaccugaagaacgaggagauggugaccaaccacauggagggggagcacaagaagcucgccgaggccaucuucaagcugacguaccagaacaaggugguccgggugcagcgccccacgccccggggcaccgugauggacaucaucagccgccgggaccagcgcggguccggccaggucgugaccuacggccugaacacguucaccaacauggaggcccagcucauccggcagauggagggggagggcguguucaagagcauccagcagcugaccgucaaggaggagaucgccgugaagaacuggcugauccgcguggggcgcgagcggcucucccgcauggcgaucagcggcgacgacugcgucgugaagccccuggacgaccgguucgccuccgcccugaccgcccucaacgacaugggcaaggugcgcaaggacauccagcagugggagccgagccggggguggaacgacuggacgcagguccccuucugcucccaccacuuccacgagcugaucaugaaggacggccgcgugcuggugguccccugccggaaccaggacgagcucaucgggcgcgcccggaucagccagggcgcgggguggucccugcgcgagaccgccugccugggcaagagcuacgcccagauguggucccucauguacuuccaccggcgcgaccugcggcuggccgccaacgcgaucugcagcgccgugcccucccacugggugccgaccagccgcaccaccugguccauccacgccacgcacgaguggaugaccaccgaggacaugcucaccgucuggaaccggguguggauccaggagaaccccuggauggaggacaagacgcccguggagagcugggaggagauccccuaccugggcaagcgcgaggaccaguggugcgggagccugaucggccucaccucccgggccaccugggccaagaacauccagaccgcgaucaaccagguccgcagccugaucgggaacgaggaguacacggacuacaugccguccaugaagcgguuccgccgcgaggaggaggaggccggcgugcugugguga

SEQ ID NO: 9723 - RNA, 9876 nt, Artificial Sequence
  derived and/or modified CDS sequence (opt1) from DENV-2__JN851116__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucaccaucauggcggccauccuggccuacaccaucggcaccaccuacuuccagcggguccugaucuucauccuccugaccgccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgugauggugcaggcggacuccgggugcgucgugagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgucacccgccuggagaaccugauguggaagcagaucacccccgagcucaaccacauccugaccgagaacgaggugaagcugacgaucaugaccggggacaucaagggcaucaugcaggccgggaagcggucccuccgcccgcagcccaccgagcugaaguacagcuggaaggcguggggcaaggccaagaugcuguccaccgagcuccacaaccacacguuccugaucgacggccccgagaccgccgagugcccgaacaccaaccgggccuggaacagccuggagguggaggacuacggguucggcgucuucaccacgaacaucuggcucaagcugaaggagcgccaggacguguucugcgacuccaagcugaugagcgccgcgaucaaggacaaccgggccgugcacgccgacaugggguacuggaucgaguccgcccucaacgacaccuggaagaucgagaaggccagcuucaucgaggucaaguccugccacuggcccaagagccacacccugugguccaacggcgugcuggagagcgagaugaucauccccaagaacuucgcgggccccgugucccagcacaacuaccgcccgggguaccacacccagaccgccggccccuggcaccucgggcggcuggagauggacuucgacuucugcgagggcacgaccgucguggugaccgaggacugcgggaaccgcggccccagccugcggaccacgaccgccagcggcaagcucaucaccgaguggugcugccgcuccugcacccugcccccgcugcgguaccgcggggaggacggcugcugguacgggauggagauccggccccucaaggagaaggaggagaaccuggucaacagccuggugacggccggccacgggcagaucgacaacuucucccucggcgugcugggcauggcgcuguuccucgaggagaugcugcgcacccgggucgggaccaagcacgccauccugcucguggccgugagcuucgucacccugaucacgggcaacauguccuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccagcaaggagcugaugaugaccaccaucgggaucguccugcucucccagagcacgauccccgaguccauccuggagcugaccgacgcccucgcgcugggcaugauggugcugaagaucguccggaacauggagaaguaccagcucgccgugaccaucauggccauccugugcgugccgaacgccgucauccugcagaacgccuggaaggugagcugcaccauccucgcgguggucuccgugagcccccugcugcucacguccagccagcagaaggccgacuggaucccccuggcccugaccaucaaggggcucaaccccaccgccaucuuccugaccacgcugucccgcaccagcaagaagcgguccuggccgcucaacgaggcgaucauggccgugggcauggucagcauccuggccuccagccugcucaagaacgacauccccaugaccggcccccugguggccgggggccugcucaccgugugcuacguccugacggggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugaccauccucauccggacgggccugcuggugaucagcggccucuucccggucuccauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacucccagaucggcgccggcguguacaaggaggggaccuuccacaccauguggcacgucacccgcggcgcggugcugaugcacaaggggaagcggaucgagcccagcugggccgacgugaagaaggaccucaucuccuacggcgggggcuggaagcuggagggcgaguggaaggagggggaggagguccaggugcuggcccucgagcccggcaagaacccccgcgccgugcagacgaagcccgggcuguucaagaccaacaccggcaccaucggggccgucagccuggacuucucccccggcacgagcggcucccccaucguggacaagaaggggaagguggucggccucuacgggaacggcguggugacccggagcggcaccuacgucuccgcgaucgcccagaccgagaaguccaucgaggacaaccccgagaucgaggacgacaucuuccgcaagaagcggcugacgaucauggaccugcaccccggggccggcaagaccaagcgcuaccugcccgccaucgugcgggaggcgaucaagcgcgggcuccggacccugauccuggccccgacccgcguggucgccgccgagauggaggaggcccuccgcggccugcccauccgguaccagacgcccgcgauccgcgccgagcacaccgggcgggagaucguggaccugaugugccacgccaccuucaccaugcgccuccugagccccauccgggugccgaacuacaaccugaucaucauggacgaggcccacuucacggaccccgccuccaucgcggcccgcggcuacaucagcacccgggucgagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugacggacuucaagggcaagaccgugugguucgucccguccaucaaggccgggaacgacaucgccgccugccuccggaagaacggcaagaaggugauccagcugagccgcaagaccuucgacuccgaguacaucaagacccggacgaacgacugggacuucguggucaccaccgacaucagcgagaugggcgcgaacuucaaggccgagcgcgugaucgacccccggcgcugcaugaagcccgugauccugaccgacggggaggagcgggucauccucgccggccccaugccggugacgcacuccagcgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgggagaaggucgacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgugaagaacaaccagauccuggaggagaacgucgagguggagaucuggaccaaggagggggagcgcaagaagcucaagccgcgguggcuggacgcccgcaucuacagcgacccccuggcccucaaggaguucaaggaguucgcggccggccggaagucccugacgcugaaccucaucaccgagaugggccgccugcccaccuucaugacccagaaggccaagaacgcccuggacaaccucgcggugcugcacacggccgaggccgggggccgggccuacaaccacgcccugagcgagcuccccgagacccuggagacccugcuccugcugacccuccuggcgacggucaccgggggcaucuuccuguuccucauguccggcaaggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugacguacguggucaucgcgauccucaccgugguggccgccaccauggccaacgagaugggcuuccuggagaagaccaagaaggacuucgggcugggcagcaucacgacccagcagccggagagcaacauccucgacaucgaccugcggcccgccuccgcguggacccuguacgccgucgccaccacguucaucacccccaugcuccgccacagcaucgagaacuccagcgugaacgugucccugaccgccaucgccaaccaggcgaccguccugaugggccucgggaagggcuggccccugagcaagauggacaucggggugccgcugcucgccaucggcugcuacucccaggugaaccccaucacgcugaccgccgcccugcuccugcuggucgcgcacuacgccaucaucgggcccggccuccaggccaaggccacccgggaggcccagaagcgcgcggccgccggcaucaugaagaaccccaccguggacgggaugacggugaucgaccuggacccgauccccuacgaccccaaguucgagaagcagcugggccaggucaugcuccuggugcugugcgugacccagguccucaugaugcggaccaccugggcccugugcgaggcccugacgcucgcgaccgggcccaucagcacccugugggagggcaacccggggcgcuucuggaacaccacgaucgccguguccauggccaacaucuuccgcggcagcuaccuggccggcgccgggcuccuguucuccaucaugaagaacaccgcgaacacccggcgcggcaccgggaacacgggcgagacccugggcgagaaguggaagaaccggcucaacgcccugggcaagagcgaguuccagaucuacaagaaguccggcauccaggagguggaccgcacccuggccaaggaggggaucaagcggggcgagaccgaccaccacgccgucagccgcggguccgcgaagcuccggugguucguggagcgcaaccuggugacgcccgagggcaaggucguggaccugggcugcgggcggggcggguggagcuacuacugcggcgggcucaagaacgugaaggaggucaagggccugaccaagggcgggcccggccacgaggagcccaucccgauguccaccuacggguggaaccuggugcgccuccagagcggcguggacgucuucuucacgccgcccgagaagugcgacacgcugcugugcgacaucggggaguccagccccaacccgaccguggaggccggccggacccuccgcgugcugaaccuggucgagaacuggcucaacaacaacacccaguucugcaucaaggugcugaaccccuacaugcccagcgugaucgagaagauggaggcccugcagcggaaguacggcggggcccugguccgcaacccgcucucccggaacagcacccacgagauguacuggguguccaacgccagcggcaacaucguguccagcgucaacaugaucucccgcaugcugaucaaccgguucacgaugcgccacaagaaggcgaccuacgagcccgacguggaccuggggagcggcacccggaacaucgggaucgaguccgagacccccaaccucgacaucaucggcaagcgcaucgagaagaucaagcaggagcacgagacgagcuggcacuacgaccaggaccaccccuacaagaccugggccuaccacggcuccuacgagaccaagcagaccgggagcgccuccagcauggugaacggcgucgugcgccugcugacgaagccgugggacgugauccccauggucacccagauggccaugaccgacaccacgcccuucgggcagcagcggguguucaaggagaaggucgacacccgcacccaggagcccaaggagggcaccaagaagcucaugaagaucacggccgaguggcuguggaaggagcugggcaagaagaagaccccgcggaugugcacccgcgaggaguucacccggaaggugcgcuccaacgcggcccucggggccaucuucacggacgagaacaaguggaaguccgcccgggaggccguggaggacuccggcuucugggagcuggucgacaaggagcgcaaccugcaccucgaggggaagugcgagaccugcguguacaacaugaugggcaagcgggagaagaagcugggggaguucggcaaggcgaagggcagccgcgccaucugguacauguggcugggggcccgguuccucgaguucgaggcccugggcuuccugaacgaggaccacugguucucccgcgagaacagccucagcgggguggagggcgaggggcugcacaagcugggcuacauccuccgggacgucuccaagaaggagggcggggcgauguacgccgacgacaccgccggcugggacacccgcaucacgcuggaggaccugaagaacgaggagauggugaccaaccacauggagggggagcacaagaagcucgccgaggccaucuucaagcugaccuaccagaacaaggugguccgggugcagcgccccacgccccggggcacggugauggacaucaucagccgccgggaccagcgcggguccggccaggucgugaccuacggccugaacaccuucaccaacauggaggcgcagcucauccggcagauggagggggagggcguguucaagagcauccagcagcugacggucaaggaggagaucgccgugaagaacuggcugauccgcguggggcgcgagcggcucucccgcauggccaucagcggcgacgacugcgucgugaagccccuggacgaccgguucgccuccgcccugaccgcgcucaacgacaugggcaaggugcgcaaggacauccagcagugggagccgagccggggguggaacgacuggacccagguccccuucugcucccaccacuuccacgagcugaucaugaaggacggccgcgugcuggugguccccugccggaaccaggacgagcucaucgggcgcgcccggaucagccagggcgccggguggucccugcgcgagaccgccugccugggcaagagcuacgcccagauguggucccucauguacuuccaccggcgcgaccugcggcuggcggccaacgccaucugcagcgccgugcccucccacugggugccgacgagccgcaccaccugguccauccacgccacccacgaguggaugaccacggaggacaugcucaccgucuggaaccggguguggauccaggagaaccccuggauggaggacaagacccccguggagagcugggaggagauccccuaccugggcaagcgcgaggaccaguggugcgggagccugaucggccucaccucccgggcgacgugggccaagaacauccagaccgccaucaaccagguccgcagccugaucgggaacgaggaguacaccgacuacaugccguccaugaagcgguuccgccgcgaggaggaggaggccggcgugcugugguga

SEQ ID NO: 9724 - RNA, 9876 nt, Artificial Sequence
  derived and/or modified CDS sequence (opt1) from DENV-2__GU370051__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgugauggugcaggcggacuccgggugcgucgugagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgucacccgccuggagaaccugauguggaagcagaucacccccgagcucaaccacauccugaccgagaacgaggugaagcugacgaucaugaccggggacaucaagggcaucaugcaggccgggaagcggucccuccgcccgcagcccaccgagcugaaguacagcuggaaggcguggggcaaggccaagaugcuguccaccgagcuccacaaccacacguuccugaucgacggccccgagaccgccgagugcccgaacaccaaccgggccuggaacagccuggagguggaggacuacggguucggcgucuucaccacgaacaucuggcucaagcugaaggagcgccaggacguguucugcgacuccaagcugaugagcgccgcgaucaaggacaaccgggccgugcacgccgacaugggguacuggaucgaguccgcccucaacgacaccuggaagaucgagaaggccagcuucaucgaggucaaguccugccacuggcccaagagccacacccugugguccaacggcgugcuggagagcgagaugaucauccccaagaacuucgcgggccccgugucccagcacaacuaccgcccgggguaccacacccagaccgccggccccuggcaccucgggcggcuggagauggacuucgacuucugcgagggcacgaccgucguggugaccgaggacugcgggaaccgcggccccagccugcggaccacgaccgccagcggcaagcucaucaccgaguggugcugccgcuccugcacccugcccccgcugcgguaccgcggggaggacggcugcugguacgggauggagauccggccccucaaggagaaggaggagaaccuggucaacagccuggugacggccggccacgggcagaucgacaacuucucccucggcgugcugggcauggcgcuguuccucgaggagaugcugcgcacccgggucgggaccaagcacgccauccugcucguggccgugagcuucgucacccugaucacgggcaacauguccuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccagcaaggagcugaugaugaccaccaucgggaucguccugcucucccagagcacgauccccgaguccauccuggagcugaccgacgcccucgcgcugggcaugauggugcugaagaucguccggaacauggagaaguaccagcucgccgugaccaucauggccauccugugcgugccgaacgccgucauccuggagaacgccuggaaggugagcugcaccacgcucgcgguggucuccgugagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgugggcauggucagcauccuggccuccagccugcucaagaacgacauccccaugaccggcccccugguggccgggggccugcucacggugugcuacguccugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccggucuccauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacucccagaucggcgccggcguguacaaggaggggaccuuccacaccauguggcacgucacgcgcggcgcggugcugaugcacaaggggaagcggaucgagcccagcugggccgacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagaccaacaccggcacgaucggggccgucagccuggacuucucccccggcaccagcggcucccccaucguggacaagaaggggaagguggucggccucuacgggaacggcguggugacccggagcggcaccuacgucuccgcgaucgcccagacggagaaguccaucgaggacaaccccgacaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcguggucgccgccgagauggaggaggcccuccgcggccugcccauccgguaccagacccccgcgauccgcgccgagcacaccgggcgggagaucguggaccugaugugccacgccaccuucacgaugcgccuccugagccccauccgggugccgaacuacaaccugaucaucauggacgaggcccacuucaccgaccccgccuccaucgcggcccgcggcuacaucagcacccgggucgagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugaccgacuucaagggcaagaccgugugguucgucccguccaucaaggccgggaacgacaucgccgccugccuccggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccccggcgcugcaugaagcccgugauccugacggacggggaggagcgggucauccucgccggccccaugccggugacccacuccagcgccgcccagcgccgggggcgcgugggccgcaaccccaagaacgacaacgaccaguacaucuacaugggggagccccuggagaacgacgaggacugcgcgcacuggaaggaggccaagaugcugcucgacaacaucaacacccccgagggcaucaucccguccauguucgagcccgagcgggagaaggucgacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgugaagaacaaccagauccuggaggagaacgucgagguggagaucuggacgaaggagggggagcgcaagaagcucaagccgcgguggcuggacgcccgcaucuacagcgacccccuggcccucaaggaguucaaggaguucgcggccggccggaagucccugacccugaaccucaucaccgagaugggccgccugcccaccuucaugacgcagaaggccaagaacgcccuggacaaccucgcggugcugcacaccgccgaggccgggggccgggccuacaaccacgcccugagcgagcuccccgagacccuggagacccugcuccugcugacgcuccuggcgaccgucaccgggggcaucuuccuguuccucauguccggcaaggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugaccuacguggucaucgcgauccucaccgugguggccgccaccauggccaacgagaugggcuuccuggagaagacgaagaaggacuucgggcugggcagcaucaccacccagcagccggagagcaacauccucgacaucgaccugcggcccgccuccgcguggacccuguacgccgucgccacgaccuucaucacccccaugcuccgccacagcaucgagaacuccagcgugaacgugucccugaccgccaucgccaaccaggcgacgguccugaugggccucgggaagggcuggccccugagcaagauggacaucggggugccgcugcucgccaucggcugcuacucccaggugaaccccaucacccugaccgccgcccugcuccugcuggucgcgcacuacgccaucaucgggcccggccuccaggccaaggccacccgggaggcccagaagcgcgcggccgccggcaucaugaagaaccccacgguggacgggaucaccgugaucgaccuggacccgauccccuacgaccccaaguucgagaagcagcugggccaggucaugcuccuggugcugugcgugacccagguccucaugaugcggaccacgugggcccugugcgaggcccugacccucgcgaccgggcccaucagcacccugugggagggcaacccggggcgcuucuggaacacgaccaucgccguguccauggccaacaucuuccgcggcagcuaccuggccggcgccgggcuccuguucuccaucaugaagaacaccgcgaacacccggcgcggcacggggaacaccggcgagacccugggcgagaaguggaagaaccggcucaacgcccugggcaagagcgaguuccagaucuacaagaaguccggcauccaggagguggaccgcacccuggccaaggaggggaucaagcggggcgagacggaccaccacgccgucagccgcggguccgcgaagcuccggugguucguggagcgcaaccuggugacccccgagggcaaggucguggaccugggcugcgggcggggcggguggagcuacuacugcggcgggcucaagaacgugaaggaggucaagggccugaccaagggcgggcccggccacgaggagcccaucccgauguccaccuacggguggaaccuggugcgccuccagagcggcguggacgucuucuucacgccgcccgagaagugcgacacccugcugugcgacaucggggaguccagccccaacccgaccguggaggccggccggacccuccgcgugcugaaccuggucgagaacuggcucaacaacaacacccaguucugcaucaaggugcugacgcccuacaugcccagcgugaucgagaagauggaggcccugcagcggaaguacggcggggcccugguccgcaacccgcucucccggaacagcacccacgagauguacuggguguccaacgccagcggcaacaucguguccagcgucaacaugaucucccgcaugcugaucaaccgguucaccaugcgccacaagaaggcgaccuacgagcccgacguggaccuggggagcggcacgcggaacaucgggaucgaguccgagacccccaaccucgacaucaucggcaagcgcaucggcaagaucaagcaggagcacgagaccagcuggcacuacgaccaggaccaccccuacaagaccugggccuaccacggguccuacgagacgaagcagaccggcagcgccuccagcauggugaacggggucgugcgccugcugaccaagccgugggacgugauccccauggucacccagauggccaugacggacaccacccccuucggccagcagcggguguucaaggagaaggucgacacccgcacgcaggagcccaaggagggcaccaagaagcucaugaagaucaccgccgaguggcuguggaaggagcuggggaagaagaagaccccgcggaugugcacgcgcgaggaguucacccggaaggugcgcuccaacgcggcccucggcgccaucuucaccgacgagaacaaguggaaguccgcccgggaggccguggaggacuccggguucugggagcuggucgacaaggagcgcaaccugcaccucgagggcaagugcgagaccugcguguacaacaugauggggaagcgggagaagaagcugggcgaguucggcaaggcgaaggggagccgcgccaucugguacauguggcugggcgcccgguuccucgaguucgaggcccugggguuccugaacgaggaccacugguucucccgcgagaacagccucagcggcguggagggggagggccugcacaagcugggcuacauccuccgggacgucuccaagaaggagggcggggcgauguacgccgacgacacggccgggugggacacccgcaucacccuggaggaccugaagaacgaggagauggugaccaaccacauggagggcgagcacaagaagcucgccgaggccaucuucaagcugacguaccagaacaaggugguccgggugcagcgccccacgccccgggggaccgugauggacaucaucagccgccgggaccagcgcggcuccggccaggucgugaccuacgggcugaacacguucaccaacauggaggcgcagcucauccggcagauggagggcgaggggguguucaagagcauccagcagcugaccgucaaggaggagaucgccguggagaacuggcugaugcgcgugggccgcgagcggcucucccgcauggccaucagcggcgacgacugcgucgugaagccccuggacgaccgguucgccuccgcccugaccgcgcucaacgacauggggaaggugcgcaaggacauccagcagugggagccgagccggggcuggaacgacuggacgcagguccccuucugcucccaccacuuccacgagcugaucaugaaggacgggcgcgugcuggugguccccugccggaaccaggacgagcucaucggccgcgcccggaucagccagggggccggcuggucccugcgcgagaccgccugccugggcaagagcuacgcccagauguggucccucauguacuuccaccggcgcgaccugcggcuggcggccaacgccaucugcagcgccgugcccucccacugggugccgaccagccgcaccaccugguccauccacgccacgcacgaguggaugaccaccgaggacaugcucaccgucuggaaccggguguggauccaggagaaccccuggauggaggacaagacgcccguggagagcugggaggagauccccuaccuggggaagcgcgaggaccaguggugcggcagccugaucgggcucaccucccgggcgaccugggccaagaacauccagaccgccaucaaccagguccgcagccugaucggcaacgaggaguacacggacuacaugccguccaugaagcgguuccgccgcgaggaggaggaggccggggugcugugguga

SEQ ID NO: 9725 - RNA, 9876 nt, Artificial Sequence
  derived and/or modified CDS sequence (opt1) from DENV-2__EU359009__SS-prME
accgccgggaucaucaucaugaugauccccaccgugauggccuuccaccugaccacccggaacggggagccccacaugaucgugagccggcaggagaagggcaagagccuccuguucaagaccgagaacggggugaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggaugagcagcgagggcgccuggaagcacgcccagcggaucgagaccuggguccuccgccacccgggguucacgaucauggcggccauccuggccuacaccaucggcaccaccuacuuccagcgggugcugaucuucauccuccugacggccaucgcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcaugguggaccggggcuggggcaacgggugcggccuguucgggaagggcgggaucgucacgugcgccauguucacgugcaagaagaacauggagggcaagaucgugcagcccgagaaccucgaguacaccaucgugaucacgccccacuccggcgaggagaacgccgucgggaacgacacgggcaagcacgggaaggagaucaaggugaccccgcagagcuccaucaccgaggccgagcugaccggcuacgggaccgugacgauggagugcagcccccgcaccggccuggacuucaacgagaugguccuccugcagauggagaacaaggccuggcuggugcaccggcagugguuccucgaccugcccuuccccuggcugccgggcgcggacacccagggguccaacuggauccagaaggagacccucgugacguucaagaacccccacgccaagaagcaggacgucgugguccugggcagccaggagggggccaugcacaccgcccugaccggcgccaccgagauccagaugagcuccgggaaccuccuguucacgggccaccugaagugccgccuccggauggacaagcugcagcugaagggcaugagcuacuccaugugcaccgggaaguucaagguggugaaggagaucgcggagacccagcacggcaccaucgucauccgcgugcaguacgagggggacggcagccccugcaagauccccuucgagaucauggaccucgagaagcggcacgugcugggccgccugaucacggucaacccgaucgugaccgagaaggacucccccgugaacaucgaggccgagccgcccuucggggacagcuacaucaucaucggcgucgagccggggcagcucaagcuguccugguucaagaagggcagcuccaucgggcagauguucgagaccaccaugcgcggcgccaagcggauggccauccugggcgacacggccugggacuucgggagccucggcgggguguucaccuccaucggcaaggcgcugcaccagguguucggggccaucuacggcgccgccuucagcggcgucuccuggaccaugaagauccugaucgggguggugaucaccuggaucggcaugaacagccgcuccacgagccucuccgucagccuggugcuggugggggucgugacccuguaccucggcgugaugguccaggcggacuccgggugcguggugagcuggaagaacaaggagcugaagugcggcagcggcaucuucaucaccgacaacguccacaccuggacggagcaguacaaguuccagcccgagucccccagcaagcuggccuccgccauccagaaggcccacgaggaggggaucugcggcauccggagcgugacccgccucgagaaccugauguggaagcagaucacccccgagcugaaccacauccucuccgagaacgaggugaagcugaccaucaugacgggggacaucaagggcaucaugcaggccgggaagcggagccugcgcccgcagcccaccgagcucaaguacuccuggaaggcguggggcaaggccaagaugcugagcaccgagcugcacaaccacaccuuccucaucgacggccccgagacggccgagugcccgaacaccaaccgggccuggaacucccuggaggucgaggacuacggguucggcguguucaccaccaacaucuggcugaagcucaaggagcgccaggacguguucugcgacagcaagcugauguccgccgcgaucaaggacaaccgggccguccacgccgacaugggguacuggaucgagagcgcccugaacgacacguggaagaucgagaaggccuccuucaucgaggucaagagcugccacuggcccaagucccacacccucuggagcaacggcgugcuggaguccgagaugaucauccccaagaacuucgcgggccccgugagccagcacaacuaccgcccgggguaccacacccagaccgccggccccuggcaccuggggcggcucgagauggacuucgacuucugcgagggcaccacggugguggucaccgaggacugcgggaaccgcggccccagccugcggaccaccacggccuccggcaagcugaucaccgaguggugcugccgcagcugcacccugccgccccugcgguaccgcggggaggacggcugcugguacgggauggagauccggccccugaaggagaaggaggagaaccucgugaacucccuggugaccgccggccacgggcagaucgacaacuucagccugggcguccucggcauggcgcuguuccuggaggagaugcuccgcacgcggguggggaccaagcacgccauccugcugguggccgucuccuucgugacccucaucaccggcaacaugagcuuccgcgaccuggggcgcgugauggucauggugggcgccacgaugaccgacgacaucgggaugggcgugaccuaccuggcccuccuggcggccuucaagguccggcccaccuucgccgccggccugcuccugcgcaagcugacguccaaggagcucaugaugaccaccaucgggaucgugcugcugagccaguccaccauccccgagacgauccucgagcugaccgacgcccuggcgcucggcaugauggugcugaagaucguccggaacauggagaaguaccagcuggccgugaccaucauggccauccucugcguccccaacgccgugauccugcagaacgccuggaaggugagcugcaccacgcuggcggucguguccgugagcccccuccugcugaccuccagccagcagaaggccgacuggaucccccucgcccugaccaucaaggggcugaaccccaccgccaucuuccucacgacccugucccgcaccagcaagaagcgguccuggccgcugaacgaggcgaucauggccgucggcauggugagcauccucgccuccagccugcugaagaacgacauccccaugaccggcccccucguggccgggggccugcugacggucugcuacgugcucaccgggcgcagcgccgaccuggagcuggagcgggcggccgacgugcgcugggaggagcaggccgagaucuccggcagcucccccauccucagcaucaccaucuccgaggacgggagcauguccaucaagaacgaggaggaggagcagacccugacgauccugauccggaccggccuccuggucaucagcggccuguucccgguguccauccccaucaccgccgccgcgugguaccucugggaggugaagaagcagcgcgccgggguccugugggacgugcccuccccgccgcccgugggcaaggccgagcuggaggacggggccuaccggaucaagcagaagggcauccucggguacucccagaucggcgccggcgucuacaaggaggggaccuuccacaccauguggcacgugacgcgcggcgcggugcugaugcacaaggggaagcggaucgagcccagcugggccgacgucaagaaggaccugaucuccuacggcgggggcuggaagcucgagggcgaguggaaggagggggaggagguccaggugcuggcccuggagcccggcaagaacccccgcgccguccagaccaagcccggccucuucaagaccaacaccggcacgaucggggccgugagccuggacuucucccccggcaccagcggcucccccaucguggacaagaaggggaaggucgugggccuguacgggaacggcguggucacccggagcggcaccuacguguccgcgaucgcccagacggagaaguccaucgaggacaaccccgagaucgaggacgacaucuuccgcaagaagcggcucaccaucauggaccugcaccccggggccggcaagaccaagcgcuaccugcccgccaucgugcgggaggcgaucaagcgcgggcugcggacccucauccuggccccgacgcgcgucguggccgccgagauggaggaggcccugcgcggccuccccauccgguaccagacccccgcgauccgcgccgagcacaccgggcgggagaucguggaccugaugugccacgccaccuucacgaugcgccugcucagccccauccgggucccgaacuacaaccugaucaucauggacgaggcccacuucaccgaccccgccuccaucgcggcccgcggcuacaucagcacccggguggagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugaccgacuucaagggcaagaccgucugguucgugccguccaucaaggccgggaacgacaucgccgccugccugcggaagaacggcaagaaggugauccagcucagccgcaagaccuucgacacggaguacaucaagacccggaccaacgacugggacuucgucgugaccacggacaucuccgagaugggcgcgaacuucaaggccgagcgcgugaucgacccccggcgcugcaugaagcccgucauccugaccgacggggaggagcgggugauccuggccggccccaugccggugacccacagcuccgccgcccagcgccgggggcgcgucggccgcaaccccaagaacgagaacgaccaguacaucuacaugggggagccccucgagaacgacgaggacugcgcgcacuggaaggaggccaagaugcugcuggacaacaucaacacccccgagggcaucaucccgagcauguucgagcccgagcgggagaagguggacgccaucgacggcgaguaccgccuccgcggggaggcccgcaagacguucguggaccugaugcggcgcggcgaccugcccgucuggcucgccuaccggguggcggccgaggggaucaacuacgccgaccgccgguggugcuucgacggcgucaagaacaaccagauccuggaggagaacguggagguggagaucuggaccaaggagggggagcgcaagaagcugaagccgcgguggcucgacgcccgcaucuacuccgacccccuggcccugaaggaguucaaggaguucgcggccggccgcaagagccucacccugaaccugaucaccgagaugggccgccuccccacguucaugacccagaaggcccggaacgcccuggacaaccuggcgguccuccacaccgccgaggccgggggccgcgccuacaaccacgcccuguccgagcugcccgagacccucgagacgcugcugcuccugacccugcucgcgaccgugaccgggggcaucuuccuguuccugaugagcggcaaggggaucggcaagaugacccucgggaugugcugcaucaucacggccuccauccugcugugguacgcccagauccagccgcacuggaucgccgccagcaucauccucgaguucuuccugaucgugcugcucauccccgagcccgagaagcagcggacgccccaggacaaccagcugaccuacgucgugaucgcgauccugaccguggucgccgccacgauggccaacgagaugggcuuccucgagaagaccaagaaggacuucgggcugggcuccaucaccacccagcagccggagagcaacauccuggacaucgaccuccgccccgccagcgcguggacgcuguacgccguggccaccaccuucaucacccccaugcugcggcacuccaucgagaacagcuccgugaacgucagccucacggccaucgccaaccaggcgaccgugcugaugggccuggggaagggcuggccccucuccaagauggacaucggggugccgcugcuggccaucggcugcuacagccaggucaaccccaucacccucaccgccgcccugcugcuccugguggcgcacuacgccaucaucgggcccggccugcaggccaaggccacgcgcgaggcccagaagcgggcggccgccggcaucaugaagaaccccaccguggacgggaucaccgucaucgaccucgacccgauccccuacgaccccaaguucgagaagcagcugggccaggugaugcugcucgugcugugcgucacccaggugcugaugaugcgcacgaccugggcccucugcgaggcccugacccuggcgaccgggcccaucuccacgcucugggagggcaacccggggcgcuucuggaacaccaccaucgccgugagcauggccaacaucuuccggggcuccuaccuggccggcgccgggcuccucuucagcaucaugaagaacaccgcgaacacgcgccggggcaccgggaacaccggcgagacccugggcgagaaguggaagaaccgccugaacgcccucgggaaguccgaguuccagaucuacaagaaguccggcauccaggaggucgaccggacgcuggccaaggaggggaucaagcgcggcgagaccgaccaccacgccgugucccgggggagcgcgaagcugcgcugguucguggagcggaaccucgucacccccgagggcaaggugguggaccugggcugcgggcgcggcgggugguccuacuacugcggcgggcugaagaacgucaaggaggugaagggccucaccaagggcgggcccggccacgaggagcccaucccgaugagcacguacggguggaaccuggugcggcugcaguccggcgucgacguguucuucacgccgcccgagaagugcgacacccuccugugcgacaucggggagagcucccccaacccgaccguggaggccggccgcacccugcggguccucaaccugguggagaacuggcugaacaacaacacgcaguucugcaucaaggugcucaaccccuacaugcccagcgucaucgagaagauggaggcccugcagcgcaaguacggcggggcccuggugcggaacccgcugagccgcaacuccacccacgagauguacugggugagcaacgccuccggcaacaucgucagcuccgugaacaugaucagccggaugcucaucaaccgcuucaccaugcggcacaagaaggcgaccuacgagcccgacguggaccugggguccggcacgcgcaacaucgggaucgagagcgagacccccaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggucaacggcguggugcggcuccugaccaagccgugggacgucauccccauggugacccagauggccaugacggacaccacccccuucgggcagcagcgcguguucaaggagaaggucgacacccggacgcaggagcccaaggagggcaccaagaagcugaugaagaucaccgccgaguggcucuggaaggagcugggcaagaagaagaccccgcgcaugugcacgcgggaggaguucacccgcaaggugcggagcaacgcggcccugggggccaucuucaccgacgagaacaaguggaaguccgcccgcgaggccgucgaggacagcggcuucugggagcucguggacaaggagcggaaccugcaccuggaggggaagugcgagaccugcguguacaacaugaugggcaagcgcgagaagaagcucggggaguucggcaaggcgaagggcucccgggccaucugguacauguggcugggggcccgcuuccuggaguucgaggcccucggcuuccugaacgaggaccacugguucagccgggagaacucccugagcggggucgagggcgaggggcuccacaagcugggcuacauccugcgcgacgugagcaagaaggagggcggggcgauguacgccgacgacacggccggcugggacacccggaucacccucgaggaccugaagaacgaggagauggugaccaaccacauggagggggagcacaagaagcuggccgaggccaucuuccgccucacguaccagaacaaggucgugcgggugcagcgccccacgccccggggcaccgucauggacaucaucucccgccgggaccagcgcgggagcggccagguggugaccuacggccugaacaccuucaccaacauggaggcgcagcugauccgccagauggagggggagggcgucuucaaguccauccagcaccucaccgugaccgaggagaucgccgugaagaacuggcugguccggguggggcgcgagcggcugagccgcauggccaucuccggcgacgacugcguggucaagccccucgacgaccgguucgccagcgcccugacggcgcugaacgacaugggcaaggugcgcaaggacauccagcagugggagccgucccggggguggaacgacuggacccaggugcccuucugcagccaccacuuccacgagcucaucaugaaggacggccgcguccugguggugcccugccggaaccaggacgagcugaucgggcgcgcccggaucucccagggcgccggguggagccuccgcgagaccgccugccugggcaaguccuacgcccagauguggagccugauguacuuccaccggcgcgaccuccggcuggcggccaacgccaucugcuccgccguccccagccacugggugccgaccucccgcaccacguggagcauccacgccacccacgaguggaugaccaccgaggacaugcugacgguguggaaccgggucuggauccaggagaaccccuggauggaggacaagacccccguggaguccugggaggagauccccuaccucggcaagcgcgaggaccaguggugcgggagccugaucggccugaccagccgggcgaccugggccaagaacauccagacggccaucaaccaggugcgcucccucaucgggaacgaggaguacaccgacuacaugccgagcaugaagcgcuuccggcgcgaggaggaggaggccggcguccugugguga

SEQ ID NO: 9726 - RNA, 9876 nt, Artificial Sequence
  derived and/or modified CDS sequence (opt1) from DENV-2__KC131142__SS-prME
accgcgggcaucaucaucauggugauccccaccgugauggccuuccaccugaccacccggaacggggagccccacaugaucgugagccggcaggagaagggcaagagccuccuguucaagaccgagaacgggcugaacaugugcacccucauggcgauggaccugggcgagcugugcgaggacaccaucaccuacaacugcccccuccugcgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcucgagacccgcaccgagaccuggauguccagcgagggcgccuggaagcacgcccagcggaucgagaccuggguccugcgccacccgggguucaccaucauggcggccauccuggccuacaccaucggcaccaccuacuuccagcgggugcucaucuucauccugcugacggccaucgcgcccuccaugaccaugcgcugcaucgggaucagcaaccgggacuucguggagggcgucuccggcgggagcuggguggacaucgugcucgagcacggcuccugcgucaccaccauggccaagaacaagcccacgcuggacuucgagcugaucaagaccgaggccaagcaccccgccacccuccgcaaguacugcaucgaggccaagcugaccaacacgaccaccgcgagccggugcccgacccagggggagcccucccugaacgaggagcaggacaagcgcuucgugugcaagcacagcaugguggaccggggcuggggcaacgggugcggccucuucgggaagggcgggaucgucacgugcgccauguucacgugcaagaagaacauggagggcaagaucgugcagcccgagaaccuggaguacaccaucgugaucacgccccacuccggcgaggagaacgccgucgggaacgacacgggcaagcacgggaaggagaucaaggugaccccgcagagcuccaucaccgaggccgagcugaccggcuacgggaccgugacgauggagugcagcccccgcaccggccucgacuucaacgagaugguccugcugcagauggagaacaaggccuggcucgugcaccggcagugguuccuggaccugccccuccccuggcugccgggcgcggacacccagggguccaacuggauccagaaggagacccuggugacguucaagaacccccacgccaagaagcaggacgucgugguccucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaagguggugaaggagaucgcggagacccagcacggcaccaucgucauccgcgugcaguacgagggggacggcagccccugcaagauccccuucgagaucauggaccuggagaagcggcacgugcucggccgccugaucacggucaacccgaucgugaccgagaaggacucccccgugaacaucgaggccgagccgcccuucggggacagcuacaucaucaucggcgucgagccggggcagcugaagcucuccugguucaagaagggcagcuccaucgggcagauguucgagaccaccaugcgcggcgccaagcggauggccauccugggcgacacggccugggacuucgggagccugggcgggguguucaccuccaucggcaaggcgcuccaccagguguucggggccaucuacggcgccgccuucagcggcgucuccuggaccaugaagauccugaucgggguggugaucaccuggaucggcaugaacagccgcuccacgagccuguccgucagccuggugcucgugggggucgugacccuguaccugggcgugaugguccaggcggacuccgggugcguggugagcuggaagaacaaggagcucaagugcggcagcggcaucuucaucaccgacaacguccacaccuggacggagcaguacaaguuccagcccgagucccccagcaagcuggccuccgccauccagaaggcccacgaggaggggaucugcggcauccggagcgugacccgccuggagaaccucauguggaagcagaucacccccgagcugaaccacauccuguccgagaacgaggugaagcucaccaucaugacgggggacaucaagggcaucaugcaggccgggaagcggagccugcgcccgcagcccaccgagcugaaguacuccuggaaggcguggggcaaggccaagaugcucagcaccgagcugcacaaccacaccuuccugaucgacggccccgagacggccgagugcccgaacaccaaccgggccuggaacucccucgaggucgaggacuacggguucggcguguucaccaccaacaucuggcugaagcugaaggagcgccaggacguguucugcgacagcaagcucauguccgccgcgaucaaggacaaccgggccguccacgccgacaugggguacuggaucgagagcgcccugaacgacacguggaagaucgagaaggccuccuucaucgaggucaagagcugccacuggcccaagucccacacccuguggagcaacggcgugcucgaguccgagaugaucauccccaagaacuucgcgggccccgugagccagcacaacuaccgcccgggguaccacacccagaccgccggccccuggcaccuggggcggcuggagauggacuucgacuucugcgagggcaccacggugguggucaccgaggacugcgggaaccgcggccccagccuccggaccaccacggccuccggcaagcugaucaccgaguggugcugccgcagcugcacccugcccccgcuccgguaccgcggggaggacggcugcugguacgggauggagauccggccccugaaggagaaggaggagaaccuggugaacucccucgugaccgccggccacgggcagaucgacaacuucagccugggcguccugggcauggcccuguuccuggaggagaugcugcgcacgcggguggggaccaagcacgccauccuccugguggccgucuccuucgugacccugaucaccggcaacaugagcuuccgcgaccucgggcgcgugauggucauggugggcgccacgaugaccgacgacaucgggaugggcgugaccuaccuggcccugcucgcggccuucaagguccggcccaccuucgccgccggccugcugcuccgcaagcugacguccaaggagcugaugaugaccaccaucgggaucgugcuccugagccaguccaccauccccgagacgauccuggagcucaccgacgcccuggcgcugggcaugauggugcucaagaucguccggaacauggagaaguaccagcuggccgugaccaucauggccauccugugcgucccgaacgccgugauccuccagaacgccuggaaggugagcugcaccacgcuggcggucguguccgugagcccccugcuccugaccuccagccagcagaaggccgacuggaucccccuggcccucaccaucaaggggcugaaccccaccgccaucuuccugacgacccucucccgcaccagcaagaagcgguccuggccgcugaacgaggcgaucauggccgucggcauggugagcauccuggccuccagccuccugaagaacgacauccccaugaccggcccccugguggccgggggccuccugacggucugcuacgugcugaccgggcgcagcgccgaccucgagcuggagcgggcggccgacgugcgcugggaggagcaggccgagaucuccggcagcucccccauccugagcaucaccaucuccgaggacgggagcauguccaucaagaacgaggaggaggagcagacccucacgauccugauccggaccggccugcucgucaucagcggccuguucccgguguccauccccaucaccgccgccgcgugguaccugugggaggugaagaagcagcgcgccgggguccucugggacgugcccagcccgccgcccgugggcaaggccgagcuggaggacggggccuaccggaucaagcagaagggcauccugggguacucccagaucggcgccggcgucuacaaggaggggaccuuccacaccauguggcacgugacgcgcggcgcggugcucaugcacaaggggaagcggaucgagcccagcugggccgacgucaagaaggaccugaucuccuacggcgggggcuggaagcuggagggcgaguggaaggagggggaggagguccaggugcucgcccuggagcccggcaagaacccccgcgccguccagaccaagcccgggcuguucaagaccaacaccggcacgaucggggccgugagccucgacuucucccccggcaccagcggcucccccaucguggacaagaaggggaaggucgugggccuguacgggaacggcguggucacccggagcggcaccuacguguccgcgaucgcccagacggagaaguccaucgaggacaaccuggagaucgaggacgacaucuuccgcaagaagcggcugaccgugauggaccuccaccccggggccggcaagaccaagcgcuaccugcccgccaucguccgggaggcgaucaagcgcgggcugcggacccucauccuggcccccacgcgcgugguggccgccgagauggaggaggcccugcgcggccucccgauccgguaccagacccccgcgauccgcgccgagcacaccgggcgggagaucgucgaccugaugugccacgccaccuucacgaugcgccugcucagccccauccgggugcccaacuacaaccugaucaucauggacgaggcccacuucaccgacccggccuccaucgcggcccgcggcuacaucagcacccggguggagaugggcgaggccgccgggaucuucaugaccgccacgccgcccggcucccgcgaccccuucccgcagagcaacgcgcccaucauggacgaggagcgggagauccccgagcgcuccuggaacagcgggcacgagugggucaccgacuucaagggcaagaccgugugguucgugcccuccaucaaggccgggaacgacaucgccgccugccugcggaagaacggcaagaaggucauccagcucagccgcaagaccuucgacacggaguacaucaagacccggaccaacgacugggacuucguggugaccacggacaucuccgagaugggcgcgaacuucaaggccgagcgcgucaucgacccgcggcgcugcaugaagcccgugauccugaccgacggggaggagcgggugauccuggccggccccaugcccgucacccacagcuccgccgcccagcgccgggggcgcgugggccgcaacccgaagaacgagaacgaccaguacaucuacaugggggagccccucgagaacgacgaggacugcgcgcacuggaaggaggccaagaugcugcuggacaacaucaacacccccgagggcaucauccccagcauguucgagccggagcgggagaagguggacgccaucgacggcgaguaccgccuccgcggggaggcccgcaagacguucgucgaccugaugcggcgcggcgaccugcccguguggcucgccuaccgggucgcggccgaggggaucaacuacgccgaccgccgguggugcuucgacggcgugaagaacaaccagauccuggaggagaacguggaggucgagaucuggaccaaggagggggagcgcaagaagcugaagccccgguggcucgacgcccgcaucuacuccgacccgcuggcccugaaggaguucaaggaguucgcggccggccgcaagagccucacccugaaccugaucaccgagaugggccgccuccccacguucaugacccagaaggcccggaacgcccuggacaaccuggcggugcuccacaccgccgaggccgggggccgcgccuacaaccacgcccuguccgagcugcccgagacccucgagacgcugcugcuccugacccugcucgcgaccgugaccgggggcaucuuccuguuccugaugagcggcaaggggaucggcaagaugacccucgggaugugcugcaucaucacggccuccauccugcugugguacgcccagauccagccccacuggaucgccgccagcaucauccucgaguucuuccugaucguccugcucaucccggagcccgagaagcagcggacgccccaggacaaccagcugaccuacguggugaucgcgauccugaccgucguggccgccacgauggccaacgagaugggcuuccucgagaagaccaagaaggacuucgggcugggcuccaucaccacccagcagcccgagagcaacauccuggacaucgaccuccgcccggccagcgcguggacgcuguacgccguggccaccaccuucaucacccccaugcugcggcacuccaucgagaacagcuccgucaacgugagccucacggccaucgccaaccaggcgaccgugcugaugggccuggggaagggcuggccccucuccaagauggacaucggggucccccugcuggccaucggcugcuacagccaggugaacccgaucacccucaccgccgcccugcugcuccugguggcgcacuacgccaucaucgggcccggccugcaggccaaggccacgcgcgaggcccagaagcgggcggccgccggcaucaugaagaaccccaccgucgacgggaucaccgugaucgaccucgaccccaucccguacgaccccaaguucgagaagcagcugggccaggugaugcugcucguccugugcgugacccaggugcugaugaugcgcacgaccugggcccucugcgaggcccugacccuggcgaccgggcccaucuccacgcucugggagggcaaccccgggcgcuucuggaacaccaccaucgccgucagcauggccaacaucuuccggggcuccuaccuggccggcgccgggcuccucuucagcaucaugaagaacaccgcgaacacgcgccggggcaccgggaacaccggcgagacccugggcgagaaguggaagaaccgccugaacgcccucgggaaguccgaguuccagaucuacaagaaguccggcauccaggagguggaccggacgcuggccaaggaggggaucaagcgcggcgagaccgaccaccacgccgugucccgggggagcgcgaagcugcgcugguucgucgagcggaaccucgugaccccggagggcaagguggucgaccugggcugcgggcgcggcgggugguccuacuacugcggcgggcugaagaacgugaaggaggugaagggccucaccaagggcgggcccggccacgaggagcccauccccaugagcacguacggguggaaccugguccggcugcaguccggcguggacguguucuucaccccgcccgagaagugcgacacccuccugugcgacaucggggagagcucccccaaccccaccgucgaggccggccgcacccugcgggugcucaaccugguggagaacuggcugaacaacaacacgcaguucugcaucaagguccugaacccguacaugcccagcgugaucgagaagauggaggcccuccagcgcaaguacggcggggcccuggugcggaacccccugagccgcaacuccacccacgagauguacugggucagcaacgccuccggcaacaucgugagcuccgugaacaugaucagccggaugcucaucaaccgcuucaccaugcggcacaagaaggcgaccuacgagccggacgucgaccugggguccggcacgcgcaacaucgggaucgagagcgagacccccaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcguggucaagcuccugaccaagcccugggacgugaucccgauggugacccagauggccaugacggacaccacccccuucgggcagcagcgggucuucaaggagaagguggacacccgcacgcaggagcccaaggagggcaccaagaagcugaugaagaucaccgccgaguggcucuggaaggagcugggcaagaagaagacgccccggaugugcacgcgcgaggaguucacccggaagguccgcagcaacgcggcccugggggccaucuucaccgacgagaacaaguggaaguccgcccggggcgccguggaggacagcggguucugggagcucguggacaaggagcgcaaccugcaccuggagggcaagugcgagaccugcgucuacaacaugauggggaagcgggagaagaagcucggcgaguucggcaaggcgaaggggucccgcgccaucugguacauguggcugggcgcccgguuccuggaguucgaggcccucggguuccugaacgaggaccacugguucagccgcgagaacucccugagcggcguggagggggagggccuccacaagcugggcuacauccugcgggacgugagcaagaaggagggcggggcgauguacgccgacgacacggccgggugggacacccgcaucacccucgaggaccugaagaacgaggagauggucaccaaccacauggagggcgugcacaagaagcuggccgaggccaucuuccggcucacguaccagaacaaggugguccgcgugcagcggccgacgccccgggggaccgugauggacaucaucucccggcgcgaccagcggggcagcggccaggucgugaccuacgggcugaacacguucaccaacauggaggcgcagcugauccgccagauggagggcgaggggguguucaaguccauccagcaccucaccgucaccgaggagaucgccgugaagaacuggcuggugcgcgucggccgggagcgccugagccggauggccaucuccggcgacgacugcguggugaagccccucgacgaccgcuucgccagcgcccugacggcgcugaacgacauggggaagguccggaaggacauccagcagugggagcccucccgcggcuggaacgacuggacccaggugccguucugcagccaccacuuccacgagcucaucaugaaggacgggcgggugcuggucgugcccugccgcaaccaggacgagcugaucggccgggcccgcaucucccagggggccggcuggagccuccgggagaccgccugccugggcaaguccuacgcccagauguggagccugauguacuuccaccgccgggaccuccgccuggcggccaacgccaucugcuccgccgugcccagccacuggguccccaccucccggaccacguggagcauccacgccacccacgaguggaugaccaccgaggacaugcugacgguguggaaccgcguguggauccaggagaacccguggauggaggacaagacccccgucgaguccugggaggagauccccuaccucgggaagcgggaggaccaguggugcggcagccugaucgggcugaccagccgcgcgaccugggccaagaacauccagacggccaucaaccaggugcggucccucaucggcaacgaggaguacaccgacuacaugcccagcaugaagcgcuuccgccgggaggaggaggaggccggggugcugugguga

SEQ ID NO: 9727 - RNA, 9876 nt, Artificial Sequence
  derived and/or modified CDS sequence (opt1) from DENV-2__AY858035__SS-prME
accgccgggaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccaccuacuuccagcgggugcugaucuucauccuccugaccgccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaagaccuggggcaaggcgaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuucugcgacagcaagcugauguccgccgccaucaaggacaaccgggcggugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgcgggccccuggcaccucgggcggcuggagauggacuucgacuucugcgagggcacgaccguggucgugaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggugaacucccuggucacggccggccacgggcagaucgacaacuucagccucggcgugcugggcauggcccuguuccucgaggagaugcugcgcacccggguggggaccaagcacgcgauccugcucgucgccguguccuucgugacccugaucacgggcaacaugagcuuccgcgaccuggggcgcgucauggugauggugggcgccaccaugaccgacgacaucgggaugggcgucaccuaccucgcccugcuggccgcguucaaggugcggcccacguucgccgccggccuccugcugcgcaagcucaccuccaaggagcugaugaugaccaccaucgggaucgugcugcucagccaguccacgauccccgagaccauccuggagcugaccgacgcccucgcccugggcaugaugguccugaagaucgugcggaacauggagaaguaccagcucgcggucaccaucauggccauccugugcgugccgaacgccgugauccugcagaacgccuggaaggucagcugcacgacccucgccgugguguccgucagcccccugcugcucaccuccagccagcagaaggcggacuggaucccccuggcccugaccaucaaggggcucaaccccacggccaucuuccugaccacccugucccgcaccagcaagaagcgguccuggccgcucaacgaggccaucauggcggugggcauggugagcauccuggccuccagccugcucaagaacgacauccccaugacgggcccccuggucgccgggggccugcucaccgugugcuacgugcugaccgggcgcagcgccgaccuggagcucgagcgggccgcggacguccgcugggaggagcaggccgagaucuccggcagcucccccauccugagcaucaccaucuccgaggacgggagcauguccaucaagaacgaggaggaggagcagacgcugaccauccucauccggaccggccugcugguggugagcggccucuucccggucuccauccccaucaccgccgccgccugguaccugugggaggugaagaagcagcgcgcgggggugcugugggacguccccagcccgccgcccgugggcaaggccgagcucgaggacggggccuaccggaucaagcagaagggcauccugggguacucccagaucggcgccggcguguacaaggaggggaccuuccacacgauguggcacgucacccgcggcgccgugcugaugcacaaggggaagcggaucgagcccagcugggcggacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagaccaacacgggcaccaucggggccgucagccuggacuucucccccggcaccagcggcucccccaucguggacaagaaggggaagguggucggccucuacgggaacggcguggugacccggagcggcacguacgucuccgccaucgcgcagaccgagaaguccaucgaggacaaccccgagaucgaggacgacaucuuccgcaagaagcggcugaccaucauggaccugcaccccggggccggcaagaccaagcgcuaccugcccgccaucgugcgggaggccaucaagcgcgggcuccggacgcugauccuggcgccgacccgcguggucgccgccgagauggaggaggcccuccgcggccugcccauccgguaccagacccccgccauccgcgcggagcacaccgggcgggagaucguggaccugaugugccacgccacguucaccaugcgccuccugagccccauccgggugccgaacuacaaccugaucaucauggacgaggcccacuucaccgaccccgccuccaucgccgcgcgcggcuacaucagcacccgggucgagaugggcgaggccgccgggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggcggggaacgacaucgccgccugccuccggaagaacggcaagaaggugauccagcugagccgcaagacguucgacuccgaguacaucaagacccggaccaacgacugggacuucguggucaccacggacaucagcgagaugggcgccaacuucaaggcggagcgcgugaucgacccccggcgcugcaugaagcccgugauccugaccgacggggaggagcgggucauccucgccggccccaugccggugacccacuccagcgccgcccagcgccgggggcgcgugggccgcaaccccaagaacgagaacgaccaguacaucuacaugggggagccccuggagaacgacgaggacugcgcccacuggaaggaggcgaagaugcugcucgacaacaucaacacccccgagggcaucaucccguccauguucgagcccgagcgggagaaggucgacgccaucgacggcgaguaccgccugcgcggggaggcccgcaagacguucguggaccugaugcggcgcggcgaccuccccgucuggcuggccuacaagguggccgcggaggggaucaacuacgccgaccggcgcuggugcuucgacggcgugaagaacaaccagauccuggaggagaacgucgagguggagaucuggaccaaggagggggagcggaagaagcucaagccgcgcuggcuggacgcccggaucuacagcgacccccuggcccucaaggaguucaaggaguucgccgcgggccgcaagucccugacccugaaccucaucaccgagaugggccggcugcccacguucaugacccagaaggcccgcaacgcccuggacaaccucgccgugcugcacaccgcggaggccgggggccgggccuacaaccacgcccugagcgagcuccccgagacccuggagacgcugcuccugcugacccuccuggccaccgucaccgggggcaucuuccuguuccucauguccggcaaggggaucggcaagaugacccuggggaugugcugcaucaucacggcgagcauccugcucugguacgcccagauccagccgcacuggaucgccgccuccaucauccuggaguucuuccugaucgugcuccugauccccgagcccgagaagcagcgcacgccccaggacaaccagcugaccuacguggucaucgccauccucaccgugguggcggccacgauggccaacgagaugggcuuccuggagaagaccaagaaggacuucgggcugggcagcaucaccacccagcagccggagagcaacauccucgacaucgaccugcggcccgccuccgccuggacgcuguacgcggucgccaccaccuucaucacccccaugcuccgccacagcaucgagaacuccagcgugaacgugucccugacggccaucgccaaccaggccaccguccugaugggccucgggaagggcuggccccugagcaagauggacaucggggugccgcugcucgcgaucggcugcuacucccaggugaaccccaucacccugaccgccgcccugcuccugcuggucgcccacuacgcgaucaucgggcccggccuccaggccaaggccacgcgggaggcccagaagcgcgccgcggccggcaucaugaagaaccccaccguggacgggaucaccgugaucgaccuggacccgauccccuacgaccccaaguucgagaagcagcugggccaggucaugcuccuggugcugugcgugacccagguccucaugaugcggacgaccugggcccugugcgaggcccugacccucgccaccgggcccaucagcacgcugugggagggcaacccggggcgcuucuggaacaccaccaucgcgguguccauggccaacaucuuccgcggcagcuaccuggccggcgccgggcuccuguucuccaucaugaagaacaccgccaacacgcggcgcggcaccgggaacaccggcgagacccugggcgagaaguggaagaaccggcucaacacgcugggcaagagcgaguuccagaucuacaagaaguccggcauccaggagguggaccgcacccuggcgaaggaggggaucaagcggggcgagaccgaccaccacgccgucagccgcggguccgccaagcuccggugguucguggagcgcaaccuggugacccccgagggcaaggucguggaccugggcugcgggcggggcggguggagcuacuacugcggcgggcucaagaacgugaaggaggucaagggccugacgaagggcgggcccggccacgaggagcccaucccgauguccaccuacggguggaaccuggugcgccuccagagcggcguggacgucuucuucacgccgcccgagaagugcgacacccugcugugcgacaucggggaguccagccccaacccgaccguggaggccggccggacgcuccgcgugcugaaccuggucgagaacuggcucaacaacaacacccaguucugcaucaaggugcugaaccccuacaugcccagcgugaucgagaagauggaggcgcugcagcggaaguacggcggggcccugguccgcaacccgcucucccggaacagcacccacgagauguacuggguguccaacgccagcggcaacaucguguccagcgucaacaugaucucccgcaugcugaucaaccgguucaccaugcgccacaagaaggccacguacgagcccgacguggaccuggggagcggcacccggaacaucgggaucgaguccgagauccccaaccucgacaucaucggcaagcgcaucgagaagaucaagcaggagcacgagaccagcuggcacuacgaccaggaccaccccuacaagaccugggccuaccacggcuccuacgagacgaagcagaccgggagcgcguccagcauggugaacggcgucgugcgccugcugaccaagccgugggacgugauccccauggucacccagauggccaugacggacaccacccccuucgggcagcagcggguguucaaggagaaggucgacacccgcacgcaggagcccaaggagggcaccaagaagcucaugaagaucaccgccgaguggcuguggaaggagcugggcaagaagaagacccggcgcaugugcacgcgggaggaguucacccgcaaggugcgguccaacgccgcccucggggcgaucuucaccgacgagaacaaguggaaguccgcccgcgaggccguggaggacuccggcuucugggagcuggucgacaaggagcggaaccugcaccucgaggggaagugcgagaccugcguguacaacaugaugggcaagcgcgagaagaagcugggggaguucggcaaggccaagggcagccgggccaucugguacauguggcugggggcgcgcuuccucgaguucgaggcccugggcuuccugaacgaggaccacugguucucccgggagaacagccucagcgggguggagggcgaggggcugcacaagcugggcuacauccuccgcgacgucuccaagaaggagggcggggccauguacgccgacgacacggcgggcugggacacccggaucacccuggaggaccugaagaacgaggagauggugaccaaccacauggagggggagcacaagaagcucgccgaggccaucuucaagcugacguaccagaacaaggugguccgcgugcagcggccgacgccccggggcaccgugauggacaucaucagccggcgcgaccagcggggguccggccaggucgugaccuacggccugaacacguucaccaacauggaggcccagcucauccgccagauggagggggagggcguguucaagagcauccagcagcugaccgucaccgaggagaucgccgugaagaacuggcuggagcgcguggggcgggagcgccucucccggauggcgaucagcggcgacgacugcgucgugaagccccuggacgaccgcuucgccuccgcccugacggcccucaacgacaugggcaaggugcggaaggacauccagcagugggagcccagccgcggguggaacgacuggacccaggucccguucugcucccaccacuuccacgagcugaucaugaaggacggccgggugcuggugguccccugccgcaaccaggacgagcucaucgggcgggcccgcaucagccagggcgcgggguggucccugcgggagaccgccugccugggcaagagcuacgcccagauguggucccucauguacuuccaccgccgggaccugcgccuggccgccaacgcgaucugcagcgccgugcccucccacugggugcccaccagccggaccacgugguccauccacgccacccacgaguggaugaccaccgaggacaugcucacggucuggaaccgcguguggauccaggagaacccguggauggaggacaagacccccguggagagcugggaggagauccccuaccugggcaagcgggaggaccaguggugcgggagccugaucggccucaccucccgcgccaccugggccaagaacauccagacggcgaucaaccagguccggagccugaucgggaacgaggaguacaccgacuacaugcccuccaugaagcgcuuccgccgggaggaggaggaggccggcgugcugugguga

SEQ ID NO: 9728 - RNA, 9873 nt, Artificial Sequence
  derived and/or modified CDS sequence (opt1) from DENV-2__JX567951__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcugacgggguacggcaccgugaccauggagugcagcccccggaccggccucgacuucaacgagauggugcugcugcagauggaggacaaggccuggcucguccaccggcagugguuccuggaccugccccuccccuggcugccgggggccgacacgcagggcagcaacuggauccagaaggagacccuggugaccuucaagaacccccacgcgaagaagcaggacguggucgugcucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccuggagaagcggcacguccucgggcgccugaucaccgugaacccgaucgugacggagaaggacagccccgucaacaucgaggcggagccgcccuucggcgacuccuacaucaucguggggguggagccgggccagcugaagcucaacugguucaagaaggggagcuccaucggccagauguucgagaccaccaugcgcggcgccaagcggauggccauccugggggacaccgccugggacuucggcagccucggcggggucuucacguccaucgggaaggcccuccaccagguguucggggcgaucuacggcgccgccuucagcgggguguccuggaccaugaagauccugaucggcgucaucaucaccuggaucgggaugaacagccgcuccaccagccuguccgugagccuggugcucgucggcguggugacgcuguaccugggggccaugguccaggcggacuccggcugcaucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgaggugaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacggucguggugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacgcgcgucggcaccaagcacgcgauccugcucguggcccugagcuucgugacccugaucaccgggaacauguccuuccgggaccucggccgcgucauggugauggugggggccacgaugaccgacgacaucggcaugggcgucaccuaccuggcccugcucgccgcguucaaggugcgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgucaccaucauggccaucuccugcgugccgaacgcggugauccuccagaacgccuggaaggucagcugcaccauccuggccgccguguccgugagcccccugcuccugaccuccagccagcagaaggcggacuggaucccccuggcccucacgaucaagggccugaaccccaccgccaucuuccugaccacccucucccggacgagcaagaagcgcuccuggccgcugaacgaggccaucauggccgucggcauggugagcauccuggcguccagccuccugaagaacgacauccccaugaccgggccccuggucgccggcgggcuccugaccgugugcuacgugcugaccggccggagcgccgaccucgagcuggagcgcgccgccgacgucaagugggaggaccaggcggagaucuccgggagcucccccauccugagcaucacgaucuccgaggacggcagcauguccaucaagaacgaggaggaggagcagacccucaccauccugauccggaccggccugcucgugaucagcgggguguucccggucuccauccccaucaccgccgccgccugguaccugugggaggugaagaagcagcgcgccggcgugcugugggacguccccagcccgccgcccguggggaaggcggagcucgaggacggcgccuaccggaucaagcagcgcgggauccugggcuacucccagaucggcgccgggguguacaaggagggcacguuccacaccauguggcacgucacccgcggggccgugcugaugcaccgcggcaagcggaucgagcccagcugggccgacgugaagaaggaccucaucuccuacgggggcggcuggaagcuggagggggaguggaaggagggcgaggagguccaggugcuggcgcucgagcccgggaagaacccccgcgccgugcagaccaagcccggcaucuucaagacgaacaccgggaccaucggcgccgucagccuggacuucucccccggcaccagcgggucccccaucguggaccggaagggcaagguggucgggcuguacggcaacggcguggugacgcgcagcggggccuacgucuccgcgaucgcccagaccgagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccugcgcacgcucauccuggcgccgacccgcguggucgccgccgagauggaggaggcccugcgggggcuccccauccgcuaccagacccccgccauccgggcggagcacaccggccgcgagaucguggaccugaugugccacgccacguucaccaugcggcugcucagccccgugcgcgucccgaacuacaaccugaucaucauggacgaggcccacuucaccgaccccgccuccaucgccgcgcggggcuacaucagcacccgcguggagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgucugguucgugccguccaucaaggccggcaacgacaucgccgccugccugcgcaagaacggcaagaaggugauccagcucagccggaagacguucgacuccgaguacgucaagacccgcgccaacgacugggacuucguggugaccaccgacaucagcgagaugggggcgaacuucaaggccgagcgggucaucgacccccgccggugcaugaagcccgugauccugacggacggcgaggagcgcgugauccuggccgggcccaugccggucacccacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaagguggacgccaucgacggggaguaccggcuccgcggcgaggcccggaagaccuucguggaccugaugcgccgcggggaccugcccgucuggcucgccuacaagguggcggccgagggcaucaacuacgccgaccgcaaguggugcuucgacgggaucaagaacaaccagauccuggaggagaacguggaggucgagaucuggacgaaggagggcgagcggaagaagcugaagccgcgcuggcucgacgcccggaucuacagcgacccccuggcgcugaaggaguucaaggaguucgccgccggccgcaagucccucacccugaaccugaucaccgagauggggcggcuccccaccuucaugacgcagaaggcccgcaacgcccuggacaaccuggcggugcuccacaccgccgaggugggcgggaaggccuacacccacgcccugagcgagcugcccgagacccucgagacgcugcugcuccugacccugcucgccgcggucaccggcggcaucuuccuguuccugauguccgggaagggcaucgggaagaugacccucggcaugugcugcaucaucaccgccagcauccugcugugguacgcccagauccagccgcacuggaucgccgccuccaucauccucgaguucuuccugaucgugcugcucauccccgagcccgagaagcagcggacgccccaggacaaccagcugaccuacgucgugaucgcgauccugaccguggucgccgccaccauggccaacgagaugggguuccucgagaagacgaagaaggaccugggcuucggcagcaucaccacccaggagagcgaguccaacauccuggacaucgaccuccgcccggccagcgcguggacccuguacgccguggccacgaccuucgugacccccaugcugcggcacuccaucgagaacagcuccgucaacgugagccucaccgccaucgcgaaccaggccacggugcugauggggcugggcaagggguggccccucuccaagauggacaucggcgucccccugcuggccaucgggugcuacagccaggugaacccgaucacccucaccgccgcccugcugcuccugguggcgcacuacgccaucaucggccccggccugcaggccaaggccacccgcgaggcccagaagcgggcggccgccgggaucaugaagaaccccacggucgacggcaucaccgugaucgaccucgagcccaucccguacgaccccaaguucgagaagcagcuggggcaggucaugcugcucauccugugcgucacccaggugcugaugaugcgcaccacgugggcccucugcgaggcccugacccuggcgaccggccccaucuccacccucugggaggggaaccccggccgguucuggaacacgaccaucgccgugagcauggccaacaucuuccgcggcuccuaccuggccggggcgggccuccuguucagcaucaugaagaacaccaccaacacgcgccgggggaccggcaacgucggcgagacccugggggagaaguggaagucccgccugaacgcccucggcaagagcgaguuccagaucuacaagaaguccgggauccaggagguggaccggacccuggccaaggagggcaucaagcgcggggagacggaccaccacgccgugagccggggcuccgccaagcugcgcugguucgucgagcggaacauggugaccccggagggcaagguggucgaccucgggugcggccgcgggggcuggagcuacuacugcgggggccugaagaacgugcgggaggugaagggccugaccaagggcggccccgggcacgaggagcccauccccauguccaccuacggcuggaaccucguccgccugcagagcgggguggacguguucuucacgccgcccgagaagugcgacacccugcucugcgacaucggcgagagcucccccaaccccaccaucgaggcgggccggacccugcgcguccugaaccucguggagaacuggcugaacaacaacacccaguucugcaucaaggugcugaacccguacaugcccagcgucaucgagaagauggagacgcuccagcggaaguacgggggcgcccuggugcgcaacccccugucccggaacagcacccacgagauguacuggguguccaacgccaccgggaacaucgucagcuccgugaacaugaucagccgcaugcugaucaaccgguucaccaugaagcacaagaaggccacguacgagccggacguggaccucggcuccgggacccgcaacaucggcaucgagagcgagauccccaaccuggacaucaucggcaagcggaucgagaagaucaagcaggagcacgagaccuccuggcacuacgaccaggaccaccccuacaagaccugggccuaccacgggagcuacgagacgaagcagaccggcuccgcgagcuccauggucaacgggguggugcgccugcucaccaagcccugggacgucgugccgauggugacccagauggccaugacggacaccacccccuucggccagcagcgcgucuucaaggagaagguggacacccggacgcaggagcccaaggagggcaccaagaagcugaugaagaucaccgccgaguggcuguggaaggagcucgggaaggagaagacgccccggaugugcacgcgggaggaguucacccgcaaggugcggagcaacgccgcccugggcgcggucuucaccgacgagaacaaguggaaguccgcccgcgaggccguggaggacgggcgguucugggagcugguggaccgcgagcggaaccuccaccuggagggcaagugcgagaccugcgucuacaacaugauggggaagcgcgagaagaagcugggcgaguucggcaaggccaaggggagccgggcgaucugguacauguggcucggcgcccgcuuccuggaguucgaggcccugggguuccucaacgaggaccacugguucucccggggcaacagccugagcgggguggagggcgagggccugcaccgccucggguacauccugcgggaggucggcaagaaggagggcggcgccauguacgccgacgacacggcggggugggacacccgcaucacccuggaggaccucaagaacgaggagauggugaccaaccacaugaagggcgagcacaagaagcuggccgaggccaucuucaagcugacguaccagaacaaggugguccgggugcagcgcccgacgccccggggcaccgugauggacaucaucucccgcaaggaccagcgggggagcggccaggucgggaccuacggccucaacacguucaccaacauggaggcccagcugauccgccagauggagggcgaggggaucuucaaguccauccagcaccugaccgccaccgaggagaucgcggugcagaacuggcucgcccgcgugggccgggagcgccugagccggauggccaucuccggggacgacugcgucgugaagcccaucgacgaccgcuucgccagcgcccugacggcgcucaacgacaugggcaaggugcggaaggacauccagcagugggagcccucccgcggguggaacgacuggacccaggucccguucugcagccaccacuuccacgagcuggugaugaaggacggccgggugcuggucgugcccugccgcaaccaggacgagcucaucggccgggcccgcaucucccagggggccggcuggagccugaaggagaccgccugccuggggaaguccuacgcccagauguggacccucauguacuuccaccggcgcgaccugcggcuggcggccaacgccaucugcagcgccgugcccucccacuggguccccaccagccgcacgaccugguccauccacgcgaagcacgaguggaugaccaccgaggacaugcucgccguguggaaccggguguggauccaggagaacccguggauggaggacaagacgcccgucgagagcugggaggaggugcccuaccugggcaagcgcgaggaccaguggugcgggucccugaucggccucaccagccgggccaccugggccaagaacauccagaccgccaucaaccaggugcgcagccugaucggcaacgagggguacacggacuacaugcccuccaugaagcgguuccgccgcgaggaggaggaggcgggcguccugugg

SEQ ID NO: 9729 - RNA, 9873 nt, Artificial Sequence
  derived and/or modified CDS sequence (opt1) from DENV-2__JX567950__SS-prME
accgccggggugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcgaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccucgagaagcggcacgugcuggggcgccugaucaccgugaacccgaucgucaccgagaaggacagccccgugaacaucgaggcggagccgcccuucggcgacuccuacaucaucgugggggucgagccgggccagcucaagcugaacugguucaagaaggggagcuccaucggccagauguucgagacgaccaugcgcggcgccaagcggauggccauccugggggacaccgccugggacuucggcagccucgggggcguguucaccuccaucgggaaggcccugcaccagguguucggcgcgaucuacggcgccgccuucagcggggucuccuggacgaugaagauccugaucggcgugaucaucaccuggaucgggaugaacagccgcuccaccagccuguccgugagccucguccuggugggcguggucacccuguaccucggggccauggugcaggcggacuccggcugcaucgugagcuggaagaacaaggagcugaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccucgagaaccugauguggaagcagaucacgcccgagcugaaccacauccucuccgagaacgaggugaagcugaccaucaugaccggcgacaucaaggggaucaugcaggccggcaagcggagccugcgcccgcagcccaccgagcucaaguacuccuggaagacguggggcaaggcgaagaugcugagcaccgagucccacaaccagaccuuccugaucgacgggcccgagaccgccgagugcccgaacacgaaccgggccuggaacagccucgaggucgaggacuacggcuucgggguguucaccaccaacaucuggcugaagcugcgcgagaagcaggacguguucugcgacuccaagcucaugagcgccgccaucaaggacaaccgggcgguccacgccgacaugggcuacuggaucgaguccgcccugaacgacaccuggaagauggagaaggccagcuucaucgaggugaaguccugccacuggcccaagagccacacccugugguccaacggcgugcucgagagcgagaugaucauccccaagaacuucgccgggcccgucucccagcacaacuaccgcccgggcuaccacacgcagaccgcggggcccuggcaccugggcaagcuggagauggacuucgacuucugcgaggggaccaccgugguggucacggaggacugcggcaaccggggccccagccuccgcaccaccaccgccagcgggaagcugaucacggaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacccgcgugggcacgaagcacgcgauccuccugguggcccugagcuucgucacccucaucaccgggaacauguccuuccgggaccugggccgcgugauggugauggucggggccaccaugacggacgacaucggcaugggcgugaccuaccuggcccuccuggccgcguucaaggugcgccccaccuucgccgccgggcugcuccugcggaagcugaccagcaaggagcucaugauggccacgaucggcaucgcccugcugucccagagcacccuccccgagaccauccuggagcugaccgacgcgcucgcccuggggaugauggcccugaagaucguccgcaacauggagaaguaccagcucgccgugacgaucauggccaucuccugcgugccgaacgcggucauccugcagaacgccuggaaggugagcugcaccauccuggccgccguguccgucagcccccuccugcugaccuccagccagcagaaggcggacuggaucccccucgcccugaccaucaagggccugaaccccacggccaucuuccucaccacccugucccggaccagcaagaagcgcuccuggccgcugaacgaggccaucauggccgugggcauggucagcauccucgcguccagccugcugaagaacgacauccccaugacggggccccucguggccggcgggcugcugaccgugugcuacguccucaccggccggagcgccgaccuggagcuggagcgcgccgccgacgugaagugggaggaccaggcggagaucuccgggagcucccccauccucagcgugaccaucuccgaggacggcagcauguccaucaagaacgaggaggaggagcagacgcugaccauccugauccggaccggccuccuggucaucagcgggguguucccgguguccauccccaucaccgccgccgccugguaccugugggaggucaagaagcagcgcgccggcgugcucugggacgugcccagcccgccgcccgucgggaaggcggagcuggaggacggcgccuaccggaucaagcagcgcgggauccugggcuacucccagaucggcgccgggguguacaaggagggcaccuuccacacgauguggcacgugacccgcggggccguccucaugcaccgcggcaagcggaucgagcccagcugggccgacgugaagaaggaccugaucuccuacgggggcggcuggaagcuggagggggaguggaaggagggcgaggaggugcagguccucgcgcuggagcccgggaagaacccccgcgccgugcagaccaagcccggcaucuucaagaccaacacggggaccaucggcgccgugagccuggacuucucccccggcaccagcgggucccccaucgucgaccggaagggcaaggugguggggcucuacggcaacggcgucgugacccgcagcggggccuacguguccgcgaucgcccagacggagaaguccaucgaggacaaccccgagaucgaggacgacaucuuccggaagaagcgccugaccaucauggaccugcaccccggcgccgggaagaccaagcgguaccugcccgccaucguccgcgaggccaucaagcggggccuccgcacccugauccuggcgccgacgcgcgugguggccgccgagauggaggaggcccuccgggggcugcccauccgcuaccagacccccgccauccgggcggagcacaccggccgcgagaucgucgaccugaugugccacgccaccuucacgaugcggcuccugagccccgugcgcgugccgaacuacaaccugaucaucauggacgaggcccacuucuccgaccccgccagcaucgccgcgcggggcuacaucuccacccgcgucgagaugggggaggccgccggcaucuucaugaccgccacgccgcccgggagccgggacccguucccccaguccaacgcgcccaucauggacgaggagcgcgagauccccgagcggagcuggaacuccggccacgagugggugacggacuucaaggggaagaccgugugguucgucccgagcaucaaggccggcaacgacaucgccgccugccuccgcaagaacggcaagaaggugauccagcugucccggaagaccuucgacagcgaguacgugaagacccgcgccaacgacugggacuucgucgugacgaccgacaucuccgagaugggggcgaacuucaaggccgagcgggugaucgacccccgccggugcaugaagcccgucauccugaccgacggcgaggagcgcgugauccucgccgggcccaugccggugacccacagcuccgccgcccagcggcgcggccgcaucgggcggaaccccaagaacgagaacgaccaguacaucuacaugggcgagccccuggagaacgacgaggacugcgcgcacuggaaggaggccaagaugcugcucgacaacaucaacacgcccgagggcaucaucccgagcauguucgagcccgagcgcgagaaggucgacgccaucgacggggaguaccggcugcgcggcgaggcccggaagaccuucguggaccugaugcgccgcggggaccuccccguguggcuggccuacaaggucgcggccgagggcaucaacuacgccgaccgcaaguggugcuucgacgggaucaagaacaaccagauccuggaggagaacguggagguggagaucuggaccaaggagggcgagcggaagaagcucaagccgcgcuggcuggacgcccggaucuacuccgacccccuggcgcucaaggaguucaaggaguucgccgccggccgcaagagccugacccugaaccucaucacggagauggggcggcugcccaccuucaugacccagaaggcccgcaacgcccuggacaaccucgcgguccugcacaccgccgaggugggcgggaaggccuacacgcacgcccugaacgagcuccccgagacccuggagacccugcuccugcugacccuccuggccgcggucacgggcggcaucuuccuguuccucauguccgggaagggcaucgggaagaugacccugggcaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugaccuacguggucaucgcgauccucacggugguggccgccaccauggccaacgagaugggguuccuggagaagaccaagaaguaccugggccucggcagcaucaccacgcaggagagcgaguccaacauccuggacaucgaccugcgcccggccagcgcguggacccucuacgccgucgccaccaccuucgugacgcccaugcugcggcacuccaucgugaacagcuccgucaacgugacccugaccgccaucgcgaaccaggccaccgugcucauggggcugggcaagggguggccccugagcaagauggacaucggcgucccccuccuggccaucgggugcuacucccaggugaacccgaucacgcugaccgccgcccuccugcugcucguggcgcacuacgccaucaucggccccggccugcaggccaaggccacccgcgaggcccagaagcgggcggccgccgggaucaugaagaaccccaccgucgacggcaucacggugaucgaccuggagcccaucccguacgaccccaaguucgagaagcagcucgggcaggucaugcugcugauccucugcgucacccaggugcugaugaugcgcaccaccugggcccugugcgaggcccucacgcuggcgaccggccccaucagcacccugugggaggggaaccccggccgguucuggaacaccacgaucgccguguccauggccaacaucuuccgcggcagcuaccucgccggggcgggccugcuguucuccaucaugaagaacaccaccaacacccgccgggggacgggcaacgucggcgagacccucggggagaaguggaagucccgccugaacgcccugggcaagaacgaguuccagaucuacaagaaguccgggauccaggagguggaccggacccucgccaaggagggcaucaagcgcggggagaccgaccaccacgccgugagccggggcuccgccaagcugcgcugguucgucgagcggaacauggugacgccggagggcaagguggucgaccuggggugcggccgcgggggcuggagcuacuacugcgggggccucaagaacgugcgggaggugaagggccugaccaagggcgggcccgggcacgaggagcccauccccauguccaccuacggcuggaaccugguccgccuccagagcgggguggacguguucuucaccccgcccgagaagugcgacacgcugcugugcgacaucggcgaguccagccccaaccccaccaucgaggcgggccggacccuccgcguccugaaccuggccgagaacuggcucaacaacaacacccaguucugcaucaaggugcugaacccguacaugcccagcgugaucgagaagauggagacccugcagcggaaguacgggggcgcccugguccgcaacccccucucccggaacagcacgcacgagauguacuggguguccaacgccaccgggaacaucgugagcuccgucaacaugaucagccgcaugcugaucaaccgguucaccaugaagcacaagaaggccaccuacgagccggacguggaccugggcuccgggacgcgcaacaucggcaucgagagcgagauccccaaccucgacaucaucggcaagcggaucgagaagaucaagcaggagcacgagaccuccuggcacuacgaccaggaccaccccuacaagaccugggcguaccacgggagcuacgagaccaagcagacgggcuccgccagcuccauggugaacggggucgugcgccugcugaccaagcccugggacguggucccgauggugacccagauggccaugaccgacacgacccccuucggccagcagcgcguguucaaggagaaggucgacacccggacccaggagcccaaggagggcacgaagaagcucaugaagaucaccgccgaguggcuguggaaggagcuggggaaggagaagacgccccggaugugcacccgggaggaguucacgcgcaaggugcggagcaacgccgcgcucggcgccguguucaccgacgagaacaaguggaaguccgcccgcgaggccgucgaggacgggcgguucugggagcugguggaccgcgagcggaaccugcaccucgagggcaagugcgagaccugcgucuacaacaugauggggaagcgcgagaagaagcugggcgaguucggcaaggcgaaggggagccgggccaucugguacauguggcugggcgcccgcuuccucgaguucgaggcccugggguuccugaacgaggaccacugguucucccgggagaacagccucuccggcguggagggggagggccugcaccgccugggcuacauccuccgggacgugagcaagaaggagggcggggccauguacgcggacgacaccgccgggugggacacgcgcaucacccuggaggaccugaagaacgaggagauggucaccaaccacaugaagggcgagcacaagaagcucgccgaggccaucuucaagcugaccuaccagaacaagguggugcggguccagcgcccgacgccccgggggaccgugauggacaucaucagccgccgggaccagcgcggcuccggccagguggggaccuacggccugaacaccuucacgaacauggaggcccagcucauccgccagauggagggggagggcaucuucaagagcauccagcaccugaccgcgaccgaggagaucgccguccagaacuggcuggcccgggugggccgcgagcggcucucccgcauggccaucagcggggacgacugcguggucaagcccaucgacgaccgguucgccuccgcgcugaccgcccugaacgacaugggcaaggugcgcaaggacauccagcagugggagcccagccggggguggaacgacuggacccaggugccguucugcucccaccacuuccacgagcucgucaugaaggacggccgcgugcuggugguccccugccggaaccaggacgagcugaucgggcgcgcccggaucagccagggcgccggcuggucccucaaggagaccgccugccugggcaagagcuacgcgcagauguggacccugauguacuuccaccgccgggaccuccgccuggccgccaacgccaucugcuccgcggugcccagccacugggugcccaccucccggaccacguggagcauccacgccaagcacgaguggaugaccaccgaggacaugcuggccgucuggaaccgcguguggauccaggagaacccguggauggaggacaagacccccguggaguccugggaggagauccccuaccucggcaagcgggaggaccaguggugcgggagccugaucggccugacgucccgcgccaccugggccaagaacauccagaccgcgaucaaccagguccggagccucaucgggaacgagggcuacaccgacuacaugcccagcaugaagcgcuuccgccgggaggaggaggaggccggcgugcugugg

SEQ ID NO: 9730 - RNA, 9873 nt, Artificial Sequence
  derived and/or modified CDS sequence (opt1) from DENV-2__HQ012538__SS-prME
accgcgggcgugaucaucaugcugauccccaccgcgauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucgccaucauggcggccauccuggccuacaccaucgggaccacccacuuccagcgggcccucaucuucauccugcugacggcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcgaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacguccuggggcgccugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccucgagaaccugauguggaagcagaucacccccgagcugaaccacauccucuccgagaacgaggugaagcugaccaucaugacgggcgacaucaaggggaucaugcaggcgggcaagcggagccugcgcccgcagcccaccgagcucaaguacuccuggaagaccuggggcaaggccaagaugcugagcaccgagucccacaaccagacguuccugaucgacgggcccgagaccgccgagugcccgaacaccaaccgggccuggaacagccucgagguggaggacuacggcuucggggucuucaccacgaacaucuggcugaagcugcgcgagaagcaggacguguucugcgacuccaagcucaugagcgccgcgaucaaggacaaccgggccgugcacgccgacaugggcuacuggaucgaguccgcccugaacgacaccuggaagauggagaaggccagcuucaucgaggucaaguccugccacuggcccaagagccacacccugugguccaacggcgugcucgagagcgagaugaucauccccaagaacuucgcggggcccgugucccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugacggccgggcacggccagaucgacaacuucucccugggcgugcuggggauggcccucuuccuggaggagaugcugcggacccgcgucggcaccaagcacgccauccuccugguggccgugagcuucgucacccugaucacggggaacauguccuuccgggaccucggccgcgugauggugauggucggggugaccaugaccgacgacaucggcaugggcgugaccuaccuggcccugcucgccgcguucaagguccgccccacguucgccgccgggcugcugcuccggaagcugaccagcaaggagcugaugauggccaccaucggcaucgcccuccugucccagagcaccauccccgagacgauccuggagcucaccgacgcgcuggcccuggggaugauggugcucaagaucgugcgcaacauggagaaguaccagcuggccgucaccaucauggccaucuccugcgugccgaacgccgugauccugcucaacgcguggaaggucagcugcaccauccuggccgccguguccgucagcccccugcuccugacguccagccagcagaagaccgacuggaucccccuggcccucaccaucaagggccugaaccccaccgcgaucuuccugacgacccucucccggaccagcaagaagcgcuccuggccgcugaacgaggccgugauggccgugggcauggucagcauccuggccuccagccuccugaagaacgacauccccaugaccgggccccugguggccggcgggcuccugacggugugcuacguccugaccggccggagcgcggaccucgagcuggagcgcgccgccgacgugaagugggaggaccaggccgagaucuccgggagcucccccauccugagcaucaccaucuccgaggacggcagcauguccaucaagaacgaggaggaggagcagacccucacgauccugauccggaccggccugcucgugaucagcggggucuucccgguguccauccccaucaccgccgcggccugguaccugugggaggugaagaagcagcgcgccggcguccugugggacgugcccagcccgccgcccguggagaaggccgagcucgaggacggggccuaccggaucaagcagcgcggcauccugggguacucccagaucggcgcgggcgucuacaaggaggggaccuuccacaccauguggcacgugacgcggggcgccgugcugaugcaccgcgggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagaccaacaccggcacgaucggggcggugagccuggacuucucccccggcaccagcggcucccccaucguggaccggaaggggaaggucgugggccucuacgggaacggcguggucacccgcagcggcgccuacguguccgccaucgcccagaccgagaaguccaucgaggacaaccccgagaucgaggacgacaucuuccggaagaagcgccugacgaucauggaccugcaccccggggcgggcaagaccaagcgguaccugcccgccaucgugcgcgaggccaucaagcgggggcuccgcacccugauccuggccccgacccgcgucguggccgcggagauggaggaggcccuccggggccugcccauccgcuaccagacgcccgccauccgggccgagcacaccgggcgcgagaucguggaccugaugugccacgccaccuucaccaugcggcuccugagccccguccgcgugccgaacuacaaccugaucaucauggacgaggcgcacuucacggaccccgccuccaucgccgcccggggcuacaucagcacccgcguggagaugggcgaggccgcggggaucuucaugaccgccacgccgcccggcucccgggacccguucccccagagcaacgcccccaucauggacgaggagcgcgagauccccgagcgguccuggaacagcgggcacgagugggucacggacuucaagggcaagaccgugugguucgugccguccaucaaggccgggaacgacaucgcggccugccuccgcaagaacggcaagaaggucauccagcugagccggaagaccuucgacuccgaguacgugaagacccgcgccaacgacugggacuucguggucacgaccgacaucagcgagaugggcgccaacuuccgggccgagcgcgugaucgacccccggcgcugcaugaagcccgugauccugaccgacggggaggagcgggucauccucgcgggccccaugccggugacccacuccagcgccgcccagcgccgcgggcggaucggccgcaaccccaagaacgagaacgaccaguacaucuacaugggggagccccuggagaacgacgaggacugcgcccacuggaaggaggccaagaugcugcucgacaacaucaacacgcccgagggcaucaucccguccauguucgagcccgagcgggagaagguggacgcgaucgacggcgaguaccgccugcgcggggaggcccgcaagaccuucgucgaccugaugcggcgcggcgaccuccccguguggcuggccuaccggguggccgccgaggggaucaacuacgcggaccgccgguggugcuucgacggcaucaagaacaaccagauccuggaggagaacgucgagguggagaucuggaccaaggagggggagcgcaagaagcucaagccgcgguggcuggacgcccgcaucuacagcgacccccuggcccucaaggaguucaaggaguucgccgcgggccggaagucccugacccugaaccucaucacggagaugggccgccugcccaccuucaugacccagaaggcccgggacgcccuggacaaccucgccguccugcacaccgccgaggccggcgggcgcgccuacaaccacgcccugagcgagcuccccgagacgcuggagacccugcuccugcugacccuccuggccaccgugaccggcgggaucuuccuguuccucauguccgggaaggggaucggcaagaugacccuggggaugugcugcaucaucaccgccagcauccugcucugguacgcgcagauccagccgcacuggaucgccgccuccaucauccuggaguucuuccugaucgugcuccugauccccgagcccgagaagcagcggacgccccaggacaaccagcugaccuacgucgugaucgccauccucacgguggucgccgcgaccauggccaacgagaugggcuuccuggagaagaccaagaaggaccuggggcucggcagcaucaccacgcaggagagcgaguccaacauccuggacaucgaccugcgcccggccagcgccuggacccucuacgccguggcgaccaccuucgugacgcccaugcugcggcacuccaucgagaacagcuccgucaacgugagccugaccgccaucgccaaccaggccaccgugcucaugggccuggggaagggcuggccccuguccaagauggacaucggggucccccuccuggcgaucggcugcuacagccaggugaacccgaucacccugacggccgcccuccugcugcucguggcccacuacgccaucaucgggcccggccugcaggcgaaggccacccgcgaggcccagaagcgcgccgccgcgggcaucaugaagaaccccaccgucgacgggaucaccgugaucgaccuggagcccaucccguacgaccccaaguucgagaagcagcucggccaggugaugcugcugauccucugcgucacccaggugcugaugaugcggaccaccugggcccugugcgaggcccucacccuggccacggggcccaucuccacccugugggagggcaaccccgggcgcuucuggaacaccaccaucgccgugagcauggcgaacaucuuccggggcuccuaccucgccggcgccgggcugcuguucagcaucaugaagaacacgaccaacacccgccggggcaccgggaacaucggcgagacgcucggcgagaaguggaagucccgccugaacgcccugggcaagagcgaguuccagaucuacaagaaguccggcauccaggaggucgaccggacccucgcgaaggaggggaucaagcgcggcgagaccgaccaccacgccgugagccggggguccgccaagcugcgcugguucguggagcggaacauggucaccccggagggcaaggugguggaccugggcugcgggcgcggcggguggagcuacuacugcggcgggcucaagaacguccgggaggugaagggccugacgaagggcgggcccggccacgaggagcccauccccauguccaccuacggguggaaccuggugcgccuccagagcggcgucgacguguucuucaccccgcccgagaagugcgacacccugcugugcgacaucggggagagcucccccaaccccacgaucgaggccggccggacccuccgcgugcugaaccuggucgagaacuggcucaacaacaacacccaguucugcaucaaggugcugaacccguacaugcccagcgugaucgagaagauggagacccugcagcggaaguacggcggggcccugguccgcaacccccucucccggaacagcacccacgagauguacuggguguccaacgcgacgggcaacaucgugagcuccgucaacaugaucagccgcaugcugaucaaccgcuucaccaugaagcacaagaaggccaccuacgagccggacguggaccugggguccggcacccggaacaucgggaucgagagcgagauccccaaccucgacaucaucggcaagcgcaucgagaagaucaagcaggagcacgagacguccuggcacuacgaccaggaccaccccuacaagaccugggccuaccacggcagcuacgagaccaagcagaccggguccgccagcuccauggugaacggcgucgugcggcugcugacgaagcccugggacguggucccgauggugacccagauggccaugaccgacaccacgcccuucgggcagcagcgcguguucaaggagaaggucgacacccggacccaggagcccaaggagggcaccaagaagcucaugcgcaucacggcggaguggcuguggaaggagcugggcaagaagaagacgccccggaugugcacccgcgaggaguucacccggaaggugcgcagcaacgccgcccucggggccaucuucacggacgagaacaaguggaaguccgcccgggaggcgguggaggacagccgcuucugggagcuggucgaccgggagcgcaaccugcaccucgagggcaagugcgagaccugcguguacaacaugauggggaagcgggagaagaagcugggcgaguucgggaaggccaagggcucccgcgccaucugguacauguggcugggcgcccgguuccucgaguucgaggcgcugggguuccugaacgaggaccacugguucagccgcggcaacagccucuccggggucgagggcgaggggcugcaccggcugggcuacauccuccgcgacgugagcaagaaggagggcggggccauguacgccgacgacaccgccggcugggacacccggaucacgcuggaggaccugaagaacgaggagauggugaccaaccacaugaagggggagcacaagaagcucgccgaggcgaucuucaagcugaccuaccagaacaaggucgugcgcgugcagcgcccgacgccccggggcacggucauggacaucaucucccgccgggaccagcgcgggagcggccaggugggcaccuacgggcugaacaccuucaccaacauggaggcccagcucauccggcagauggagggcgaggggaucuucaaguccauccagcaccugacggugaccgaggagaucgccguccagaacuggcuggcccgcgugggccgggagcgccucagccggauggccaucuccggcgacgacugcguggucaagccccuggacgaccgcuucgcgagcgcccugaccgcccucaacgacauggggaaggugcggaaggacauccagcagugggagcccucccgcggcuggaacgacuggacccaggugccguucugcagccaccacuuccacgagcuggucaugaaggacgggcgggugcuggugguccccugccgcaaccaggacgagcucaucggccgggcccgcaucucccagggggccggcuggagccugaaggagacggcgugccugggcaaguccuacgcccagauguggacccucauguacuuccaccggcgcgaccugcggcuggccgccaacgccaucugcagcgcggugcccucccacugggugcccaccagccgcaccaccugguccauccacgccaagcacgaguggaugacgaccgaggacaugcucgccgucuggaaccgcguguggauccaggagaacccguggauggaggacaagacccccguggagagcugggaggagguccccuaccuggggaagcgggaggaccaguggugcggcagccugaucgggcucaccucccgcgccacgugggcgaagaacauccagaccgccaucaaccaggugcggagccugaucggcaacgaggaguacaccgacuacaugcccuccaugaagcgcuuccggcgcgaggaggaggaggccggggugcugugg

SEQ ID NO: 9731 - RNA, 9873 nt, Artificial Sequence
  derived and/or modified CDS sequence (opt1) from DENV-2__HQ012533__SS-prME
accgccggggugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucgccaucauggcggccauccuggccuacaccaucgggaccacccacuuccagcgggcccucaucuucauccugcugaccgcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcgaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacguccuggggcgccugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccucgagaaccugauguggaagcagaucacccccgagcugaaccacauccucuccgagaacgaggugaagcugaccaucaugacgggcgacaucaaggggaucaugcaggcgggcaagcggagccugcgcccgcagcccaccgagcucaaguacuccuggaagaccuggggcaaggccaagaugcugagcaccgagucccacaaccagacguuccugaucgacgggcccgagaccgccgagugcccgaacaccaaccgggccuggaacagccucgagguggaggacuacggcuucggggucuucaccacgaacaucuggcugaagcugcgcgagaagcaggacguguucugcgacuccaagcucaugagcgccgcgaucaaggacaaccgggccgugcacgccgacaugggcuacuggaucgaguccgcccugaacgacaccuggaagauggagaaggccagcuucaucgaggucaaguccugccacuggcccaagagccacacccugugguccaacggcgugcucgagagcgagaugaucauccccaagaacuucgcggggcccgugucccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugacggccgggcacggccagaucgacaacuucucccugggcgugcuggggauggcccucuuccuggaggagaugcugcggacccgcgucggcaccaagcacgccauccuccugguggccgugagcuucgucacccugaucacggggaacauguccuuccgggaccucggccgcgugauggugauggucggggugaccaugaccgacgacaucggcaugggcgugaccuaccuggcccugcucgccgcguucaagguccgccccacguucgccgccgggcugcugcuccggaagcugaccagcaaggagcugaugauggccaccaucggcaucgcccuccugucccagagcaccauccccgagacgauccuggagcucaccgacgcgcuggcccuggggaugauggugcucaagaucgugcgcaacauggagaaguaccagcuggccgucaccaucauggccaucuccugcgugccgaacgccgugauccugcucaacgcguggaaggucagcugcaccauccuggccgccguguccgucagcccccugcuccugacguccagccagcagaagaccgacuggaucccccuggcccucaccaucaagggccugaaccccaccgcgaucuuccugacgacccucucccggaccagcaagaagcgcuccuggccgcugaacgaggccgugauggccgugggcauggucagcauccuggccuccagccuccugaagaacgacauccccaugaccgggccccugguggccggcgggcuccugacggugugcuacguccugaccggccggagcgcggaccucgagcuggagcgcgccgccgacgugaagugggaggaccaggccgagaucuccgggagcucccccauccugagcaucaccaucuccgaggacggcagcauguccaucaagaacgaggaggaggagcagacccucacgauccugauccggaccggccugcucgugaucagcggggucuucccgguguccauccccaucaccgccgcggccugguaccugugggaggugaagaagcagcgcgccggcguccugugggacgugcccagcccgccgcccguggggaaggccgagcucgaggacggcgccuaccggaucaagcagcgcgggauccugggcuacucccagaucggcgcgggggucuacaaggagggcaccuuccacaccauguggcacgugacgcgcggggcggugcugaugcaccgcggcaagcggaucgagcccagcugggccgacgucaagaaggaccucaucuccuacgggggcggcuggaagcuggagggggaguggaaggagggcgaggagguccaggugcuggcccucgagcccgggaagaacccccgcgccguccagaccaagcccggccuguucaagaccaacaccgggacgaucggcgcggugagccuggacuucucccccggcaccagcgggucccccaucguggaccggaagggcaaggucguggggcucuacggcaacggcguggucacccgcagcggggccuacguguccgccaucgcccagaccgagaaguccaucgaggacaaccccgagaucgaggacgacaucuuccggaagaagcgccugacgaucauggaccugcaccccggcgcggggaagaccaagcgguaccugcccgccaucgugcgcgaggccaucaagcggggccuccgcacccugauccuggccccgacccgcgucguggccgcggagauggaggaggcccuccgggggcugcccauccgcuaccagacgcccgccauccgggccgagcacaccggccgcgagaucguggaccugaugugccacgccaccuucaccaugcggcuccugagccccguccgcgugccgaacuacaaccugaucaucauggacgaggcgcacuucacggaccccgccuccaucgccgcccggggcuacaucagcacccgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggucacggacuucaaggggaagaccgugugguucgugccguccaucaaggccggcaacgacaucgcggccugccuccgcaagaacggcaagaaggucauccagcugagccggaagaccuucgacuccgaguacgugaagacccgcgccaacgacugggacuucguggucacgaccgacaucagcgagaugggggccaacuuccgggccgagcgcgugaucgacccccggcgcugcaugaagcccgugauccugaccgacggcgaggagcgggucauccucgcggggcccaugccggugacccacuccagcgccgcccagcgccgcggccggaucgggcgcaaccccaagaacgagaacgaccaguacaucuacaugggcgagccccuggagaacgacgaggacugcgcccacuggaaggaggccaagaugcugcucgacaacaucaacacgcccgagggcaucaucccguccauguucgagcccgagcgggagaagguggacgcgaucgacggggaguaccgccugcggggcgaggcccgcaagaccuucgucgaccugaugcggcgcggggaccuccccguguggcuggccuaccggguggccgccgagggcaucaacuacgcggaccgccgguggugcuucgacgggaucaagaacaaccagauccuggaggagaacgucgagguggagaucuggaccaaggagggcgagcgcaagaagcucaagccgcgguggcuggacgcccgcaucuacagcgacccccuggcccucaaggaguucaaggaguucgccgcgggccggaagucccugacccugaaccucaucacggagauggggcgccugcccaccuucaugacccagaaggcccgggacgcccuggacaaccucgccguccugcacaccgccgaggcgggcgggcgcgccuacaaccacgcccugagcgagcuccccgagacgcuggagacccugcuccugcugacccuccuggccaccgugacgggcggcaucuuccuguuccucauguccgggaagggcaucgggaagaugacccugggcaugugcugcaucaucaccgccagcauccugcucugguacgcgcagauccagccgcacuggaucgccgccuccaucauccuggaguucuuccugaucgugcuccugauccccgagcccgagaagcagcggacgccccaggacaaccagcugaccuacgucgugaucgccauccucacgguggucgccgcgaccauggccaacgagaugggguuccuggagaagaccaagaaggaccugggccucggcagcaucaccacgcaggagagcgaguccaacauccuggacaucgaccugcgcccggccagcgccuggacccucuacgccguggcgaccaccuucgugacgcccaugcugcggcacuccaucgagaacagcuccgucaacgugagccugaccgccaucgccaaccaggccaccgugcucauggggcugggcaagggguggccccuguccaagauggacaucggcgucccccuccuggcgaucgggugcuacagccaggugaacccgaucacccugacggccgcccuccugcugcucguggcccacuacgccaucaucggccccggccugcaggcgaaggccacccgcgaggcccagaagcgcgccgccgcggggaucaugaagaaccccaccgucgacggcaucaccgugaucgaccuggagcccaucccguacgaccccaaguucgagaagcagcucggccaggugaugcugcugauccucugcgucacccaggugcugaugaugcggaccaccugggcccugugcgaggcccucacccuggccacgggccccaucuccacccugugggaggggaaccccggccgcuucuggaacaccaccaucgccgugagcauggcgaacaucuuccggggcuccuaccucgccggggccggccugcuguucagcaucaugaagaacacgaccaacacccgccgggggaccggcaacaucggcgagacgcucggggagaaguggaagucccgccugaacgcccugggcaagagcgaguuccagaucuacaagaaguccgggauccaggaggucgaccggacccucgcgaaggagggcaucaagcgcggggagaccgaccaccacgccgugagccggggcuccgccaagcugcgcugguucguggagcggaacauggucaccccggagggcaaggugguggaccuggggugcggccgcgggggcuggagcuacuacugcgggggccucaagaacguccgggaggugaagggccugacgaagggcgggcccgggcacgaggagcccauccccauguccaccuacggcuggaaccuggugcgccuccagagcggggucgacguguucuucaccccgcccgagaagugcgacacccugcugugcgacaucggcgagagcucccccaaccccacgaucgaggccggccggacccuccgcgugcugaaccuggucgagaacuggcucaacaacaacacccaguucugcaucaaggugcugaacccguacaugcccagcgugaucgagaagauggagacccugcagcggaaguacgggggcgcccugguccgcaacccccucucccggaacagcacccacgagauguacuggguguccaacgcgacggggaacaucgugagcuccgucaacaugaucagccgcaugcugaucaaccgcuucaccaugaagcacaagaaggccaccuacgagccggacguggaccugggcuccgggacccggaacaucggcaucgagagcgagauccccaaccucgacaucaucggcaagcgcaucgagaagaucaagcaggagcacgagacguccuggcacuacgaccaggaccaccccuacaagaccugggccuaccacgggagcuacgagaccaagcagaccggcuccgccagcuccauggugaacggggucgugcggcugcugacgaagcccugggacguggucccgauggugacccagauggccaugaccgacaccacgcccuucggccagcagcgcguguucaaggagaaggucgacacccggacccaggagcccaaggagggcaccaagaagcucaugcgcaucacggcggaguggcuguggaaggagcuggggaagaagaagacgccccggaugugcacccgcgaggaguucacccggaaggugcgcagcaacgccgcccucggcgccaucuucacggacgagaacaaguggaaguccgcccgggaggcgguggaggacagccgcuucugggagcuggucgaccgggagcgcaaccugcaccucgaggggaagugcgagaccugcguguacaacaugaugggcaagcgggagaagaagcugggggaguucggcaaggccaagggcucccgcgccaucugguacauguggcugggggcccgguuccucgaguucgaggcgcugggcuuccugaacgaggaccacugguucagccgcgggaacagccucuccggcgucgagggggagggccugcaccggcugggcuacauccuccgcgacgugagcaagaaggagggcggggccauguacgccgacgacaccgccgggugggacacccggaucacgcuggaggaccugaagaacgaggagauggugaccaaccacaugaagggcgagcacaagaagcucgccgaggcgaucuucaagcugaccuaccagaacaaggucgugcgcgugcagcgcccgacgccccgggggacggucauggacaucaucucccgccgggaccagcgcggcagcggccagguggggaccuacggccugaacaccuucaccaacauggaggcccagcucauccggcagauggagggggagggcaucuucaaguccauccagcaccugacggugaccgaggagaucgccguccagaacuggcuggcccgcgugggccgggagcgccucagccggauggccaucuccggggacgacugcguggucaagccccuggacgaccgcuucgcgagcgcccugaccgcccucaacgacaugggcaaggugcggaaggacauccagcagugggagcccucccgcggguggaacgacuggacccaggugccguucugcagccaccacuuccacgagcuggucaugaaggacggccgggugcuggugguccccugccgcaaccaggacgagcucaucgggcgggcccgcaucucccagggcgccggcuggagccugaaggagacggcgugccuggggaaguccuacgcccagauguggacccucauguacuuccaccggcgcgaccugcggcuggccgccaacgccaucugcagcgcggugcccucccacugggugcccaccagccgcaccaccugguccauccacgccaagcacgaguggaugacgaccgaggacaugcucgccgucuggaaccgcguguggauccaggagaacccguggauggaggacaagacccccguggagagcugggaggagguccccuaccugggcaagcgggaggaccaguggugcgggagccugaucggccucaccucccgcgccacgugggcgaagaacauccagaccgccaucaaccaggugcggagccugaucgggaacgaggaguacaccgacuacaugcccuccaugaagcgcuuccggcgcgaggaggaggaggccggcgugcugugg

SEQ ID NO: 9732 - RNA, 9873 nt, Artificial Sequence
  derived and/or modified CDS sequence (opt1) from DENV-2__HQ012534__SS-prME
accgccggggugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccaccccggcuucgccaucauggcggccauccuggccuacaccaucgggaccacccacuuccagcgggcccucaucuucauccugcugaccgcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccuguucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcgaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacguccuggggcgccugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccucgagaaccugauguggaagcagaucacccccgagcugaaccacauccucuccgagaacgaggugaagcugaccaucaugacgggcgacaucaaggggaucaugcaggcgggcaagcggagccugcgcccgcagcccaccgagcucaaguacuccuggaagaccuggggcaaggccaagaugcugagcaccgagucccacaaccagacguuccugaucgacgggcccgagaccgccgagugcccgaacaccaaccgggccuggaacagccucgagguggaggacuacggcuucggggucuucaccacgaacaucuggcugaagcugcgcgagaagcaggacguguucugcgacuccaagcucaugagcgccgcgaucaaggacaaccgggccgugcacgccgacaugggcuacuggaucgaguccgcccugaacgacaccuggaagauggagaaggccagcuucaucgaggucaaguccugccacuggcccaagagccacacccugugguccaacggcgugcucgagagcgagaugaucauccccaagaacuucgcggggcccgugucccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugacggccgggcacggccagaucgacaacuucucccugggcgugcuggggauggcccucuuccuggaggagaugcugcggacccgcgucggcaccaagcacgccauccuccugguggccgugagcuucgucacccugaucacggggaacauguccuuccgggaccucggccgcgugauggugaugcuggggguccccaugaccgacgacaucggcaugggcgugaccuaccuggcccuccuggccgcguucaaggugcgccccaccuucgccgccgggcugcuccugcggaagcugacgagcaaggagcucaugauggccaccaucggcaucgcccugcugucccagagcaccaucccggagaccauccucgagcugacggacgcgcuggcccucgggaugaugguccugaagaucgugcgcaacauggagaaguaccagcuggccgugaccaucauggccaucuccugcguccccaacgccgugauccuccugaacgcguggaaggugagcugcaccauccuggccgccgucuccgugagcccccuccugcugaccuccagccagcagaagacggacuggaucccccucgcccugaccaucaagggccugaacccgaccgcgaucuuccucaccacgcugucccggaccagcaagaagcgcuccuggccccugaacgaggccgucauggccgugggcauggugagcauccucgccuccagccugcugaagaacgacauccccaugaccgggccccucgucgccggcgggcugcugaccgugugcuacgugcucacgggccggagcgcggaccuggagcuggagcgcgccgccgacgucaagugggaggaccaggccgagaucuccgggagcuccccgauccucagcaucaccaucuccgaggacggcagcauguccaucaagaacgaggaggaggagcagacccugaccauccugauccggacgggccuccuggugaucagcgggguguuccccgucuccauccccaucaccgccgcggccugguaccugugggaggugaagaagcagcgcgccggcgugcucugggacguccccagcccgccgcccguggggaaggccgagcuggaggacggcgccuaccggaucaagcagcgcgggauccugggcuacucccagaucggcgcggggguguacaaggagggcaccuuccacaccauguggcacgucacccgcggggcggugcucaugcaccgcggcaagcggaucgagccgagcugggccgacgugaagaaggaccugaucuccuacgggggcggcuggaagcuggagggggaguggaaggagggcgaggagguccaggugcucgcccuggagcccgggaagaacccccgcgccgugcagacgaagcccggccuguucaagaccaacaccgggaccaucggcgcggucagccucgacuucuccccgggcacgagcgggucccccaucguggaccggaagggcaagguggucgggcuguacggcaacggcguggugacccgcagcggggccuacgucuccgccaucgcccagaccgagaaguccaucgaggacaaccccgagaucgaggacgacaucuuccggaagaagcgccugaccaucauggaccugcaccccggcgcggggaagacgaagcgguaccucccggccaucgugcgcgaggccaucaagcggggccugcgcacccugauccucgcccccacccgcguggucgccgcggagauggaggaggcccugcgggggcugcccauccgcuaccagacccccgccauccgggccgagcacacgggccgcgagaucguggaccucaugugccacgccaccuucaccaugcggcugcugagcccggugcgcguccccaacuacaaccucaucaucauggacgaggcgcacuucaccgaccccgccuccaucgccgcccggggcuacaucagcacgcgcguggagaugggggaggccgcgggcaucuucaugaccgccacgccgcccgggucccgggaccccuucccccagagcaacgcccccaucauggacgaggagcgcgagauccccgagcgguccuggaacagcggccacgagugggugaccgacuucaaggggaagacggucugguucgugcccuccaucaaggccggcaacgacaucgcggccugccugcgcaagaacggcaagaaggugauccagcugagccggaagaccuucgacuccgaguacgucaagacccgcgccaacgacugggacuucguggugaccacggacaucagcgagaugggggccaacuuccgggccgagcgcgucaucgacccccggcgcugcaugaagcccgugauccucaccgacggcgaggagcgggugauccuggcggggccgaugcccgucacccacuccagcgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacaccccggagggcaucauccccuccauguucgagcccgagcgggagaagguggacgcgaucgacggggaguaccgccugcggggcgaggcccgcaagacguucguggaccucaugcggcgcggggaccugccggucuggcuggccuaccggguggccgccgagggcaucaacuacgcggaccgccgguggugcuucgacgggaucaagaacaaccagauccucgaggagaacguggaggucgagaucuggaccaaggagggcgagcgcaagaagcugaagccccgguggcuggacgcccgcaucuacagcgacccccucgcccugaaggaguucaaggaguucgccgcgggccggaagucccugacccucaaccugaucaccgagauggggcgccugcccacguucaugacccagaaggcccgggacgcccucgacaaccuggccgugcugcacaccgccgaggcgggcgggcgcgccuacaaccacgcccucagcgagcugccggagacccuggagacgcuccugcugcucacccugcuggccaccgucaccggcggcaucuuccucuuccugauguccgggaagggcaucgggaagaugacgcugggcaugugcugcaucaucaccgccagcauccuccugugguacgcgcagauccagccccacuggaucgccgccuccaucauccuggaguucuuccucaucgugcugcugauccccgagcccgagaagcagcggaccccgcaggacaaccagcucaccuacguggucaucgccauccugaccgugguggccgcgacgauggccaacgagaugggguuccuggagaagaccaagaaggaccucggccugggcagcaucaccacccaggagagcgaguccaacauccuggacaucgaccuccgccccgccagcgccuggacgcuguacgccgucgcgaccaccuucgugacccccaugcugcggcacuccaucgagaacagcuccgugaacgucagccucacggccaucgccaaccaggccaccgugcugauggggcugggcaagggguggccccucuccaagauggacaucggcgugccgcugcuggcgaucgggugcuacagccaggucaaccccaucacccucaccgccgcccugcugcuccugguggcccacuacgccaucaucggccccggccugcaggcgaaggccacgcgcgaggcccagaagcgcgccgccgcggggaucaugaagaaccccaccguggacggcaucaccgucaucgaccucgagccgauccccuacgaccccaaguucgagaagcagcugggccaggugaugcugcucauccugugcgugacccagguccugaugaugcggacgaccugggcccucugcgaggcccugacccuggccaccggccccaucuccacgcucugggaggggaacccgggccgcuucuggaacaccaccaucgccgugagcauggcgaacaucuuccggggcuccuaccuggccggggccggccuccucuucagcaucaugaagaacaccacgaacacccgccgggggaccggcaacaucggcgagacccugggggagaaguggaagucccgccugaacgcccucggcaagagcgaguuccagaucuacaagaaguccgggauccaggagguggaccggacgcuggcgaaggagggcaucaagcgcggggagaccgaccaccacgccgucagccggggcuccgccaagcugcgcugguucguggagcggaacauggugacccccgagggcaaggucguggaccucgggugcggccgcgggggcuggagcuacuacugcgggggccugaagaacgugcgggaggucaagggccugaccaagggcgggcccgggcacgaggagcccaucccgauguccacguacggcuggaaccucgugcgccugcagagcgggguggacgucuucuucacgccgcccgagaagugcgacacccugcucugcgacaucggcgagagcucccccaacccgaccaucgaggccggccggacgcugcgcgugcugaaccucguggagaacuggcugaacaacaacacccaguucugcaucaagguccugaaccccuacaugcccagcgugaucgagaagauggagacccugcagcggaaguacgggggcgcccucgugcgcaacccgcugucccggaacagcacccacgagauguacugggucuccaacgcgaccgggaacaucgugagcuccgugaacaugaucagccgcaugcugaucaaccgcuucacgaugaagcacaagaaggccaccuacgagcccgacgucgaccucggcuccgggacccggaacaucggcaucgagagcgagauccccaaccuggacaucaucggcaagcgcaucgagaagaucaagcaggagcacgagaccuccuggcacuacgaccaggaccaccccuacaagacgugggccuaccacgggagcuacgagaccaagcagaccggcuccgccagcuccauggugaacggggugguccggcugcucaccaagccgugggacguggugcccauggucacgcagauggccaugaccgacaccacccccuucggccagcagcgcguguucaaggagaagguggacacgcggacccaggagcccaaggagggcaccaagaagcugaugcgcaucaccgcggaguggcuguggaaggagcucgggaagaagaagacgccgcggaugugcacccgcgaggaguucacccggaagguccgcagcaacgccgcccugggcgccaucuucaccgacgagaacaaguggaaguccgcccgggaggcgguggaggacagccgcuucugggagcugguggaccgggagcgcaaccuccaccuggaggggaagugcgagacgugcgucuacaacaugaugggcaagcgggagaagaagcugggggaguucggcaaggccaagggcucccgcgccaucugguacauguggcucggggcccgguuccuggaguucgaggcgcugggcuuccucaacgaggaccacugguucagccgcgggaacagccuguccggcguggagggggagggccugcaccggcucggcuacauccugcgcgacgucagcaagaaggagggcggggccauguacgccgacgacaccgccgggugggacacccggaucacccuggaggaccucaagaacgaggagauggugacgaaccacaugaagggcgagcacaagaagcuggccgaggcgaucuucaagcugaccuaccagaacaaggugguccgcgugcagcgccccacgccccgggggaccgugauggacaucaucucccgccgggaccagcgcggcagcggccaggucgggacguacggccucaacaccuucaccaacauggaggcccagcugauccggcagauggagggggagggcaucuucaaguccauccagcaccugaccgugacggaggagaucgccgugcagaacuggcucgcccgcgucggccgggagcgccugagccggauggccaucuccggggacgacugcguggugaagccccuggacgaccgcuucgcgagcgcccucaccgcccugaacgacaugggcaagguccggaaggacauccagcagugggagccgucccgcggguggaacgacuggacccaggugcccuucugcagccaccacuuccacgagcuggugaugaaggacggccggguccucguggugcccugccgcaaccaggacgagcugaucgggcgggcccgcaucucccagggcgccggcuggagccugaaggagaccgcgugccucgggaaguccuacgcccagauguggacgcugauguacuuccaccggcgcgaccugcggcucgccgccaacgccaucugcagcgcgguccccucccacugggugccgaccagccgcaccaccugguccauccacgccaagcacgaguggaugaccacggaggacaugcuggccguguggaaccgcgucuggauccaggagaaccccuggauggaggacaagacccccguggagagcugggaggaggugcccuaccugggcaagcgggaggaccaguggugcgggagccucaucggccugaccucccgcgccaccugggcgaagaacauccagacggccaucaaccagguccggagccugaucgggaacgaggaguacaccgacuacaugccguccaugaagcgcuuccggcgcgaggaggaggaggccggcgugcucugg

SEQ ID NO: 9733 - RNA, 9873 nt, Artificial Sequence
  derived and/or modified CDS sequence (opt1) from DENV-2__HQ012535__SS-prME
accgcgggcgugaucaucaugcugauccccaccgcgauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucgccaucauggcggccauccuggccuacaccaucgggaccacccacuuccagcgggcccucaucuucauccugcugacggcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcgaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacguccuggggcgccugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccucgagaaccugauguggaagcagaucacccccgagcugaaccacauccucuccgagaacgaggugaagcugaccaucaugacgggcgacaucaaggggaucaugcaggcgggcaagcggagccugcgcccgcagcccaccgagcucaaguacuccuggaagaccuggggcaaggccaagaugcugagcaccgagucccacaaccagacguuccugaucgacgggcccgagaccgccgagugcccgaacaccaaccgggccuggaacagccucgagguggaggacuacggcuucggggucuucaccacgaacaucuggcugaagcugcgcgagaagcaggacguguucugcgacuccaagcucaugagcgccgcgaucaaggacaaccgggccgugcacgccgacaugggcuacuggaucgaguccgcccugaacgacaccuggaagauggagaaggccagcuucaucgaggucaaguccugccacuggcccaagagccacacccugugguccaacggcgugcucgagagcgagaugaucauccccaagaacuucgcggggcccgugucccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugacggccgggcacggccagaucgacaacuucucccugggcgugcuggggauggcccucuuccuggaggagaugcugcggacccgcgucggcaccaagcacgccauccuccugguggccgugagcuucgucacccugaucacggggaacauguccuuccgggaccucggccgcgugauggugauggucggggugaccaugaccgacgacaucggcaugggcgugaccuaccuggcccugcucgccgcguucaagguccgccccacguucgccgccgggcugcugcuccggaagcugaccagcaaggagcugaugauggccaccaucggcaucgcccuccugucccagagcaccauccccgagacgauccuggagcucaccgacgcgcuggcccuggggaugauggugcucaagaucgugcgcaacauggagaaguaccagcuggccgucaccaucauggccaucuccugcgugccgaacgccgugauccugcucaacgcguggaaggucagcugcaccauccuggccgccguguccgucagcccccugcuccugacguccagccagcagaagaccgacuggaucccccuggcccucaccaucaagggccugaaccccaccgcgaucuuccugacgacccucucccggaccagcaagaagcgcuccuggccgcugaacgaggccgugauggccgugggcauggucagcauccuggccuccagccuccugaagaacgacauccccaugaccgggccccugguggccggcgggcuccugacggugugcuacguccugaccggccggagcgcggaccucgagcuggagcgcgccgccgacgugaagugggaggaccaggccgagaucuccgggagcucccccauccugagcaucaccaucuccgaggacggcagcauguccaucaagaacgaggaggaggagcagacccucacgauccugauccggaccggccugcucgugaucagcggggucuucccgguguccauccccaucaccgccgcggccugguaccugugggaggugaagaagcagcgcgccggcguccugugggacgugcccagcccgccgcccguggagaaggccgagcucgaggacggggccuaccggaucaagcagcgcggcauccugggguacucccagaucggcgcgggcgucuacaaggaggggaccuuccacaccauguggcacgugacgcggggcgccgugcugaugcaccgcgggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguucaagaccaacaccggcacgaucggggcggugagccuggacuucucccccggcaccagcggcucccccaucguggaccggaaggggaaggucgugggccucuacgggaacggcguggucacccgcagcggcgccuacguguccgccaucgcccagaccgagaaguccaucgaggacaaccccgagaucgaggacgacaucuuccggaagaagcgccugacgaucauggaccugcaccccggggcgggcaagaccaagcgguaccugcccgccaucgugcgcgaggccaucaagcgggggcuccgcacccugauccuggccccgacccgcgucguggccgcggagauggaggaggcccuccggggccugcccauccgcuaccagacgcccgccauccgggccgagcacaccgggcgcgagaucguggaccugaugugccacgccaccuucaccaugcggcuccugagccccguccgcgugccgaacuacaaccugaucaucauggacgaggcgcacuucacggaccccgccuccaucgccgcccggggcuacaucagcacccgcguggagaugggcgaggccgcggggaucuucaugaccgccacgccgcccggcucccgggacccguucccccagagcaacgcccccaucauggacgaggagcgcgagauccccgagcgguccuggaacagcgggcacgagugggucacggacuucaagggcaagaccgugugguucgugccguccaucaaggccgggaacgacaucgcggccugccuccgcaagaacggcaagaaggucauccagcugagccggaagaccuucgacuccgaguacgugaagacccgcgccaacgacugggacuucguggucacgaccgacaucagcgagaugggcgccaacuuccgggccgagcgcgugaucgacccccggcgcugcaugaagcccgugauccugaccgacggggaggagcgggucauccucgcgggccccaugccggugacccacuccagcgccgcccagcgccgcgggcggaucggccgcaaccccaagaacgagaacgaccaguacaucuacaugggggagccccuggagaacgacgaggacugcgcccacuggaaggaggccaagaugcugcucgacaacaucaacacgcccgagggcaucaucccguccauguucgagcccgagcgggagaagguggacgcgaucgacggcgaguaccgccugcgcggggaggcccgcaagaccuucgucgaccugaugcggcgcggcgaccuccccguguggcuggccuaccggguggccgccgaggggaucaacuacgcggaccgccgguggugcuucgacggcaucaagaacaaccagauccuggaggagaacgucgagguggagaucuggaccaaggagggggagcgcaagaagcucaagccgcgguggcuggacgcccgcaucuacagcgacccccuggcccucaaggaguucaaggaguucgccgcgggccggaagucccugacccugaaccucaucacggagaugggccgccugcccaccuucaugacccagaaggcccgggacgcccuggacaaccucgccguccugcacaccgccgaggccggcgggcgcgccuacaaccacgcccugagcgagcuccccgagacgcuggagacccugcuccugcugacccuccuggccaccgugaccggcgggaucuuccuguuccucauguccgggaaggggaucggcaagaugacccuggggaugugcugcaucaucaccgccagcauccugcucugguacgcgcagauccagccgcacuggaucgccgccuccaucauccuggaguucuuccugaucgugcuccugauccccgagcccgagaagcagcggacgccccaggacaaccagcugaccuacgucgugaucgccauccucacgguggucgccgcgaccauggccaacgagaugggcuuccuggagaagaccaagaaggaccuggggcucggcagcaucaccacgcaggagagcgaguccaacauccuggacaucgaccugcgcccggccagcgccuggacccucuacgccguggcgaccaccuucgugacgcccaugcugcggcacuccaucgagaacagcuccgucaacgugagccugaccgccaucgccaaccaggccaccgugcucaugggccuggggaagggcuggccccuguccaagauggacaucggggucccccuccuggcgaucggcugcuacagccaggugaacccgaucacccugacggccgcccuccugcugcucguggcccacuacgccaucaucgggcccggccugcaggcgaaggccacccgcgaggcccagaagcgcgccgccgcgggcaucaugaagaaccccaccgucgacgggaucaccgugaucgaccuggagcccaucccguacgaccccaaguucgagaagcagcucggccaggugaugcugcugauccucugcgucacccaggugcugaugaugcggaccaccugggcccugugcgaggcccucacccuggccacggggcccaucuccacccugugggagggcaaccccgggcgcuucuggaacaccaccaucgccgugagcauggcgaacaucuuccggggcuccuaccucgccggcgccgggcugcuguucagcaucaugaagaacacgaccaacacccgccggggcaccgggaacaucggcgagacgcucggcgagaaguggaagucccgccugaacgcccugggcaagagcgaguuccagaucuacaagaaguccggcauccaggaggucgaccggacccucgcgaaggaggggaucaagcgcggcgagaccgaccaccacgccgugagccggggguccgccaagcugcgcugguucguggagcggaacauggucaccccggagggcaaggugguggaccugggcugcgggcgcggcggguggagcuacuacugcggcgggcucaagaacguccgggaggugaagggccugacgaagggcgggcccggccacgaggagcccauccccauguccaccuacggguggaaccuggugcgccuccagagcggcgucgacguguucuucaccccgcccgagaagugcgacacccugcugugcgacaucggggagagcucccccaaccccacgaucgaggccggccggacccuccgcgugcugaaccuggccgagaacuggcucaacaacaacacccaguucugcaucaagguccugaacccguacaugcccagcgugaucgagaagauggagacccugcagcggaaguacggcggggcgcuggugcgcaacccccucucccggaacagcacccacgagauguacugggucuccaacgccacgggcaacaucgugagcuccgugaacaugaucagccgcaugcugaucaaccgcuucaccaugaagcacaagaaggccaccuacgagccggacgucgaccugggguccggcacccggaacaucgggaucgagagcgagauccccaaccucgacaucaucggcaagcgcaucgagaagaucaagcaggagcacgagacguccuggcacuacgaccaggaccaccccuacaagaccugggccuaccacggcagcuacgagaccaagcagaccggguccgccagcuccauggugaacggcgugguccggcugcugacgaagcccugggacguggugccgauggucacccagauggcgaugaccgacaccacgcccuucgggcagcagcgcguguucaaggagaagguggacacccggacccaggagcccaaggagggcaccaagaagcucaugcgcaucacggccgaguggcuguggaaggagcugggcaagaagaagacgccccggaugugcacccgcgaggaguucacccggaagguccgcagcaacgccgcccucggggccaucuucacggacgagaacaaguggaaguccgcgcgggaggccguggaggacagccgcuucugggagcugguggaccgggagcgcaaccugcaccucgagggcaagugcgagaccugcgucuacaacaugauggggaagcgggagaagaagcugggcgaguucgggaaggccaagggcucccgcgccaucugguacauguggcugggcgcgcgguuccucgaguucgaggcccugggguuccugaacgaggaccacugguucagccgcggcaacagccucuccgggguggagggcgaggggcugcaccggcugggcuacauccuccgcgacgucagcaagaaggagggcggggccauguacgccgacgacaccgccggcugggacacccggaucacgcuggaggaccugaagaacgaggagauggugaccaaccacaugaagggggagcacaagaagcucgcggaggccaucuucaagcugaccuaccagaacaaggugguccgcgugcagcgcccgacgccccggggcacggugauggacaucaucucccgccgggaccagcgcgggagcggccaggucggcaccuacgggcugaacaccuucaccaacauggaggcccagcucauccggcagauggagggcgaggggaucuucaaguccauccagcaccugacggugaccgaggagaucgccgugcagaacuggcuggcccgcgucggccgggagcgccucagccggauggcgaucuccggcgacgacugcguggugaagccccuggacgaccgcuucgccagcgcccugaccgcccucaacgacauggggaagguccggaaggacauccagcagugggagcccucccgcggcuggaacgacuggacccaggugccguucugcagccaccacuuccacgagcuggugaugaaggacgggcggguccugguggugcccugccgcaaccaggacgagcucaucggccgggcccgcaucucccagggggcgggcuggagccugaaggagacggccugccugggcaaguccuacgcccagauguggacccucauguacuuccaccggcgcgaccugcggcuggccgccaacgcgaucugcagcgccguccccucccacugggugcccaccagccgcaccaccugguccauccacgccaagcacgaguggaugacgaccgaggacaugcucgccguguggaaccgcgucuggauccaggagaacccguggauggaggacaagacccccguggagagcugggaggaggugcccuaccuggggaagcgggaggaccaguggugcggcagccugaucgggcucaccucccgcgcgacgugggccaagaacauccagaccgccaucaaccagguccggagccugaucggcaacgaggaguacaccgacuacaugcccuccaugaagcgcuuccggcgcgaggaggaggaggccggggugcugugg

SEQ ID NO: 9734 - RNA, 9873 nt, Artificial Sequence
  derived and/or modified CDS sequence (opt1) from DENV-2__HQ012536__SS-prME
accgccggcgugaucaucaugcugauccccaccgccauggcguuccaccucaccacccggaacggggagccgcacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcgccacccgggcuucgccaucauggcggccauccuggccuacaccaucgggaccacccacuuccagcgggcccucaucuucauccugcugacggcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccuguucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcaaggagaucaagaucaccccgcaguccagcaucaccgaggccgagcucaccggguacggcaccgugacgauggagugcagcccccggaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggcuggacaagcugcagcucaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccuggagaagcggcacguccuggggcgccucaucacggugaacccgaucgugaccggcaaggacagccccgucaacaucgaggccgagccgcccuucggggacuccuacaucaucaucggcguggagccggggcagcugaagcugaacugguucaagaagggcagcuccaucggccagauguucgagaccaccaugcgcggggccaagcggauggccauccucggcgacacggccugggacuucgggagccugggcgggguguucaccuccaucggcaaggcgcugcaccaggucuucggcgccaucuacggggccgccuucagcggcguguccuggaccaugaagauccugaucggggugaucaucaccuggaucggcaugaacagccgcuccacgagccucuccgucagccuggugcuggugggggucgugacccucuaccugggcgcgauggugcaggccgacuccggcugcgucgugagcuggaagaacaaggagcugaagugcggguccggcaucuucaucaccgacaacgugcacaccuggacggagcaguacaaguuccagcccgagagccccagcaagcucgccuccgccauccagaaggcccacgaggaggggaucugcggcauccggagcgucacccgccuggagaaccugauguggaagcagaucacccccgagcucaaccacauccuguccgagaacgaggugaagcugaccaucaugacgggggacaucaagggcaucaugcaggcgggcaagcggagccuccgcccgcagcccaccgagcugaaguacuccuggaagaccugggggaaggccaagaugcugagcaccgagucccacaaccagacguuccucaucgacggccccgagaccgccgagugcccgaacaccaaccgggccuggaacagccuggagguggaggacuacggguucggcgucuucaccacgaacaucuggcugaagcuccgcgagaagcaggacguguucugcgacuccaagcugaugagcgccgcgaucaaggacaaccgggccgugcacgccgacaugggcuacuggaucgaguccgcccugaacgggaccuggaagauggagaaggccagcuucaucgaggucaaguccugccacuggcccaagagccacacccucugguccaacggcgugcuggagagcgagaugaucauccccaagaacuucgcggggcccgugucccagcacaacuaccgcccgggcuaccacacccagaccgccgggcccuggcaccugggcaagcucgagauggacuucgacuucugcgagggcacgaccgucguggugaccgaggacugcgggaaccggggccccagccugcgcaccacgaccgccagcgggaagcugaucaccgaguggugcugccgguccugcacccucccgccccugcgcuaccggggcgaggacgggugcugguacggcauggagauccgcccccugaaggagaaggaggagaaccucgucaacagccuggugacggccggccacgggcagaucgacaacuucucccugggcgugcucgggauggcgcuguuccuggaggagaugcuccggacccgcgucggcaccaagcacgccauccugcugguggccgugagcuucgucacccucaucacggggaacauguccuucaaggaccugggccgggugauggugauggucggcguggccaugaccgacgacaucgggaugggcgugaccuaccuggcccuccuggcggccuucaagguccgccccaccuucgccgccgggcugcuccugcgcaagcugacgagcaaggagcucaugauggccaccaucggcaucacccugcugucccagagcaccauccccgagacgauccucgagcugaccgacgcgcuggcccucggcaugauggugcugaagaucgugcggaacauggagaaguaccagcuggccgucaccaucauggccaucuccugcgugcccaacgccgugauccuccugaacgcguggaaggucagcugcaccauccuggccgccguguccgucagcccccuccugcugacguccagccagcagaagaccgacuggaucccccucgcccugaccaucaaggggcugaaccccaccgcgaucuuccucacgacccugucccgcaccagcaagaagcgguccuggccgcugaacgaggccgugauggccgugggcauggucagcauccucgccuccagccugcugaagaacgacauccccaugaccgggccccucguggccggcgggcugcugacggugugcuacguccucaccggccgcagcgcggaccuggagcuggagcgggccgccgacgugaagugggaggaccaggccgagaucuccggcagcucccccauccucagcaucaccaucuccgaggacgggagcauguccaucaagaacgaggaggaggagcagacccugacgauccugauccgcaccggccuccuggugaucagcggggucuucccgguguccauccccaucaccgccgcggccugguaccugugggaggugaagaagcagcgggccggcguccucugggacgugcccuccccgccgcccguggggaaggccgagcuggaggacggcgccuaccgcaucaagcagcggggcauccugggguacucccagaucggcgcgggggucuacaaggagggcaccuuccacaccauguggcacgugacgcgcggggccgugcucaugcaccggggcaagcgcaucgagcccagcugggccgacgucaagaaggaccugaucuccuacggcgggggcuggaagcuggagggggaguggaaggagggcgaggagguccaggugcucgcccuggagcccgggaagaacccccgggccguccagaccaagcccggccuguucaagaccaacaccggcacgaucggggcggugagccucgacuucucccccggcaccagcgggucccccaucguggaccgcaagggcaaggucgugggccuguacgggaacggcguggucacccggagcggggccuacguguccgccaucgcccagaccgagaaguccaucgaggacaaccccgagaucgaggacgacaucuuccgcaagaagcggcugacgaucauggaccugcaccccggcgcggggaagaccaagcgcuaccuccccgccaucgugcgggaggccaucaagcgcggccugcggacccugauccucgccccgacccgcgucguggccgcggagauggaggaggcccugcgcggccugcccauccgguaccagacgcccgccauccgcgccgagcacaccgggcgggagaucguggaccucaugugccacgccaccuucaccaugcgccugcugagccccguccgggugccgaacuacaaccucaucaucauggacgaggcgcacuucacggaccccgccuccaucgccgcccgcggcuacaucagcacccggguggagaugggggaggccgcgggcaucuucaugaccgccacgccgcccgggucccgcgacccguucccccagagcaacgcccccaucauggacgaggagcgggagauccccgagcgcuccuggaacagcggccacgagugggucacggacuucaagggcaagaccgugugguucgugccguccaucaaggccgggaacgacaucgcggccugccugcggaagaacggcaagaaggucauccagcugagccgcaagaccuucgacuccgaguacgugaagacccgggccaacgacugggacuucguggucacgaccgacaucagcgagaugggggccaacuuccgcgccgagcgggugaucgacccccgccggugcaugaagcccgugauccucaccgacggcgaggagcgcgucauccuggcggggcccaugccggugacccacuccagcgccgcccagcggcgcggccgcgugggccggaaccccaagaacgagaacgaccaguacaucuacaugggggagccccuggagaacgacgaggacugcgcccacuggaaggaggccaagaugcuccuggacaacaucaacacgcccgagggcaucaucccguccauguucgagcccgagcgcgagaaggucgacgcgaucgacggggaguaccggcugcgcggcgaggcccggaagaccuucguggaccucaugcgccgcggggaccugcccguguggcuggccuaccgcgucgccgccgagggcaucaacuacgcggaccggcgcuggugcuucgacggcaucaagaacaaccagauccucgaggagaacguggaggucgagaucuggaccaaggagggggagcggaagaagcugaagccgcgcuggcuggacgcccggaucuacagcgacccccucgcccugaaggaguucaaggaguucgccgcgggccgcaagucccugacccucaaccugaucacggagauggggcggcugcccaccuucaugacccagaaggcccgcgacgcccucgacaaccuggccgugcugcacaccgccgaggcgggcggccgggccuacaaccacgcccucagcgagcugcccgagacgcuggagacccuccugcugcucacccugcuggccaccgugaccggcgggaucuuccucuuccugauguccgggaaggggaucgggaagaugacccugggcaugugcugcaucaucaccgccagcauccuccugugguacgcgcagauccagccgcacuggaucgccgccuccaucauccuggaguucuuccucaucguccugcugauccccgagcccgagaagcagcgcacgccccaggacaaccagcucaccuacguggugaucgccauccugacggucguggccgcgaccauggccaacgagaugggcuuccuggagaagaccaagaaggaccucgggcugggcagcaucaccacgcaggagagcgaguccaacauccuggacaucgaccuccggccggccagcgccuggacccuguacgccguggcgaccaccuucgucacgcccaugcugcgccacuccaucgagaacagcuccgugaacgugagccucaccgccaucgccaaccaggccaccguccugauggggcugggcaagggguggccccucuccaagauggacaucggcgugccccugcuggcgaucggcugcuacagccaggugaacccgaucacccucacggccgcccugcugcuccuggucgcccacuacgccaucaucgggcccggccugcaggcgaaggccacccgggaggcccagaagcgcgccgccgcggggaucaugaagaaccccaccguggacggcaucaccgugaucgaccucgagcccaucccguacgaccccaaguucgagaagcagcuggggcaggucaugcugcucauccugugcgugacccaggugcugaugaugcgcaccaccugggcccucugcgaggcccugacccuggccacgggccccaucuccacccucugggagggcaaccccgggcgguucuggaacaccaccaucgccgucagcauggcgaacaucuuccgcggcuccuaccuggccggggccggccuccucuucagcaucaugaagaacacgaccaacacccggcgcggcaccgggaacaucggcgagacgcugggggagaaguggaagucccggcugaacgcccucggcaagagcgaguuccagaucuacaagaaguccgggauccaggagguggaccgcacccuggcgaaggagggcaucaagcggggcgagaccgaccaccacgccgugagccgcggguccgccaagcugcggugguucgucgagcgcaacauggugaccccggagggcaagguggucgaccucgggugcggccgcggcggguggagcuacuacugcggcgggcugaagaacgugcgcgaggugaaggggcugacgaagggcggccccgggcacgaggagcccauccccauguccaccuacggcuggaaccucguccggcugcagagcggcguggacguguucuucaccccgcccgagaagugcgacacccugcucugcgacaucggggagagcucccccaaccccacgaucgaggccggccgcacccugcggguccugaaccucguggagaacuggcugaacaacaacacccaguucugcaucaaggugcugaacccguacaugcccagcgucaucgagaagauggagacccugcagcgcaaguacgggggcgcccucgugcggaacccccugucccgcaacagcacccacgagauguacuggguguccaacgcgacggggaacaucgucagcuccgugaacaugaucagccggaugcugaucaaccgcuucaccaugaagcacaagaaggccaccuacgagccggacguggaccucggcuccggcacccgcaacaucgggaucgagagcgagauccccaaccuggacaucaucggcaagcggaucgagaagaucaagcaggagcacgagacguccuggcacuacgaccaggaccaccccuacaagaccugggccuaccacgggagcuacgagaccaagcagaccggcuccgccagcuccauggucaacggcguggugcgccugcucacgaagcccugggacgucgugccgauggugacccagauggccaugaccgacaccacgcccuucgggcagcagcgggucuucaaggagaagguggacacccgcacccaggagcccaaggagggcaccaagaagcugaugcggaucacggcggaguggcuguggaaggagcucgggaagaagaagacgccccgcaugugcacccgggaggaguucacccgcaaggugcggagcaacgccgcccugggcgccaucuucacggacgagaacaaguggaaguccgcccgcgaggcggucgaggacagccgguucugggagcugguggaccgcgagcggaaccuccaccuggaggggaagugcgagaccugcgucuacaacaugaugggcaagcgcgagaagaagcugggcgaguucgggaaggccaagggcucccgggccaucugguacauguggcucggggcccgcuuccuggaguucgaggcgcugggcuuccucaacgaggaccacugguucagccgggggaacagccuguccggcguggagggcgaggggcugcaccgccucggcuacauccugcgggacgugagcaagaaggagggcggcgccauguacgccgacgacaccgccgggugggacacccgcaucacgcuggaggaccucaagaacgaggagauggucaccaaccacaugaagggcgagcacaagaagcuggccgaggcgaucuucaagcugaccuaccagaacaagguggugcggguccagcgcccgacgccccgcggcaccgugauggacaucaucucccggcgcgaccagcgggggagcggccagguggggaccuacggccucaacaccuucaccaacauggaggcccagcugauccgccagauggagggcgaggggaucuucaaguccauccagcaccugacggucaccgaggagaucgccgugcagaacuggcucgcccgggugggccgcgagcggcugagccgcauggccaucuccggggacgacugcgucgugaagccccuggacgaccgguucgcgagcgcccucaccgcccugaacgacaugggcaaggugcgcaaggacauccagcagugggagcccucccggggguggaacgacuggacccaggucccguucugcagccaccacuuccacgagcuggugaugaaggacggccgcgugcucgucgugcccugccggaaccaggacgagcugaucggccgcgcccggaucucccagggggccggcuggagccugaaggagacggcgugccucgggaaguccuacgcccagauguggacccugauguacuuccaccgccgggaccugcgccucgccgccaacgccaucugcagcgcggugcccucccacuggguccccaccagccggaccaccugguccauccacgccaagcacgaguggaugacgaccgaggacaugcuggccguguggaaccgcguguggauccaggagaacccguggaugggcgacaagacccccgucgagagcugggaggaggugcccuaccuggggaagcgcgaggaccaguggugcggcagccucaucggccugaccucccgggccacgugggcgaagaacauccagaccgccaucaaccaggugcgcagccugaucgggaacgaggaguacaccgacuacaugcccuccaugaagcgguuccgccgggaggaggaggaggccggcguccucugg

SEQ ID NO: 9735 - RNA, 9873 nt, Artificial Sequence
  derived and/or modified CDS sequence (opt1) from DENV-2__HQ012537__SS-prME
accgcgggcgugaucaucaugcugauccccaccgcgauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucgccaucauggcggccauccuggccuacaccaucgggaccacccacuuccagcgggcccucaucuucauccugcugacggcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucaucugcaagcacuccaugguggaccggggcugggggaacggcugcggccucuucggcaagggcgggaucgugacgugcgccauguucacgugcaagaagaacauggagggcaaggucgugcugcccgagaaccuggaguacaccaucgugaucacgccccacagcggggaggagcacgccgucggcaacgacacggggaagcacggcaaggagaucaagaucaccccgcaguccagcaucaccgaggccgagcucaccggguacggcaccgugacgauggagugcagcccccgcaccggccuggacuucaacgagauggugcugcuccagauggaggagaaggccuggcugguccaccggcagugguuccuggaccucccccugcccuggcugccgggggcggacacccagggcagcaacuggauccagaaggagacccucgugacguucaagaacccccacgccaagaagcaggacguggucgugcuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgucaaggagaucgcggagacccagcacgggaccaucgugauccgcgugcaguacgagggcgacggcucccccugcaagauccccuucgagaucauggaccucgagaagcggcacguccuggggcgccugaucacggugaacccgaucgugaccgagaaggacagccccgucaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcguguucaccuccaucgggaaggcgcugcaccaggucuucggcgccaucuacggcgccgccuucagcgggguguccuggaccaugaagauccugaucggcgugaucaucaccuggaucgggaugaacagccgcuccacgagccuguccgucagccucgugcuggugggcgucgugacccuguaccucggggcgauggugcaggccgacuccggcugcgucgugagcuggaagaacaaggagcugaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccucgagaaccugauguggaagcagaucacccccgagcugaaccacauccucuccgagaacgaggugaagcugaccaucaugacgggcgacaucaaggggaucaugcaggcgggcaagcggagccugcgcccgcagcccaccgagcucaaguacuccuggaagaccuggggcaaggccaagaugcugagcaccgagucccacaaccagacguuccugaucgacgggcccgagaccgccgagugcccgaacaccaaccgggccuggaacagccucgagguggaggacuacggcuucggggucuucaccacgaacaucuggcugaagcugcgcgagaagcaggacguguucugcgacuccaagcucaugagcgccgcgaucaaggacaaccgggccgugcacgccgacaugggcuacuggaucgaguccgcccugaacgacaccuggaagauggagaaggccagcuucaucgaggucaaguccugccacuggcccaagagccacacccugugguccaacggcgugcucgagagcgagaugaucauccccaagaacuucgcggggcccgugucccagcacaacuaccgcccgggcuaccacacccagaccgccgggcccuggcaccugggcaagcuggagauggacuucgacuucugcgaggggacgaccgucguggugaccgaggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugacggccgggcacggccagaucgacaacuucucccugggcgugcuggggauggcccucuuccuggaggagaugcugcggacccgcgucggcaccaagcacgccauccuccugguggccgugagcuucgucacccugaucacggggaacauguccuuccgggaccucggccgcgugauggugauggucggggugaccaugaccgacgacaucggcaugggcgugaccuaccuggcccugcucgccgcguucaagguccgccccacguucgccgccgggcugcugcuccggaagcugaccagcaaggagcugaugauggccaccaucggcaucgcccuccugucccagagcaccauccccgagacgauccuggagcucaccgacgcgcuggcccuggggaugauggugcuccgcaucgugcggaacauggagaaguaccagcuggccgucaccaucauggccaucuccugcgugccgaacgccgugauccugcucaacgcguggaaggucagcugcaccauccuggccgccguguccgucagcccccugcuccugacguccagccagcagaagaccgacuggaucccccuggcccucaccaucaagggccugaaccccaccgcgaucuuccugacgacccucucccgcaccagcaagaagcgguccuggccgcugaacgaggccgugauggccgugggcauggucagcauccuggccuccagccuccugaagaacgacauccccaugaccgggccccugguggccggcgggcuccugacggugugcuacguccugaccggccgcagcgcggaccucgagcuggagcgggccgccgacgugaagugggaggaccaggccgagaucuccgggagcucccccauccugagcaucaccaucuccgaggacggcagcauguccaucaagaacgaggaggaggagcagacccucacgauccugauccgcaccggccugcucgugaucagcggggucuucccgguguccauccccaucaccgccgcggccugguaccugugggaggugaagaagcagcgggccggcguccugugggacgugcccagcccgccgcccguggagaaggccgagcucgaggacggggccuaccgcaucaagcagcggggcauccugggguacucccagaucggcgcgggcgucuacaaggaggggaccuuccacaccauguggcacgugacgcgcggcgccgugcugaugcaccgggggaagcgcaucgagcccagcugggccgacgucaagaaggaccucaucuccuacggcgggggcuggaagcuggagggcgaguggaaggagggggaggagguccaggugcuggcccucgagcccggcaagaacccccgggccguccagaccaagcccgggcuguucaagaccaacaccggcacgaucggggcggugagccuggacuucucccccggcaccagcggcucccccaucguggaccgcaaggggaaggucgugggccucuacgggaacggcguggucacccggagcggcgccuacguguccgccaucgcccagaccgagaaguccaucgaggacaaccccgagaucgaggacgacaucuuccgcaagaagcggcugacgaucauggaccugcaccccggggcgggcaagaccaagcgcuaccugcccgccaucgugcgggaggccaucaagcgcgggcuccgcacccugauccuggccccgacccgggucguggccgcggagauggaggaggcccuccgcggccugcccauccgguaccagacgcccgccauccgcgccgagcacaccgggcgggagaucguggaccugaugugccacgccaccuucaccaugcgccuccugagccccguccgggugccgaacuacaaccugaucaucauggacgaggcgcacuucacggaccccgccuccaucgccgcccgcggcuacaucagcacccggguggagaugggcgaggccgcggggaucuucaugaccgccacgccgcccggcucccgcgacccguucccccagagcaacgcccccaucauggacgaggagcgggagauccccgagcgcuccuggaacagcgggcacgagugggucacggacuucaagggcaagaccgugugguucgugccguccaucaaggccgggaacgacaucgcggccugccuccggaagaacggcaagaaggucauccagcugagccgcaagaccuucgacuccgaguacgugaagacccgggccaacgacugggacuucguggucacgaccgacaucagcgagaugggcgccaacuuccgcgccgagcgggugaucgacccccgccggugcaugaagcccgugauccugaccgacggggaggagcgcgucauccucgcgggccccaugccggugacccacuccagcgccgcccagcgccgggggcgcaucggccggaaccccaagaacgagaacgaccaguacaucuacaugggggagccccuggagaacgacgaggacugcgcccacuggaaggaggccaagaugcugcucgacaacaucaacacgcccgagggcaucaucccguccauguucgagcccgagcgcgagaagguggacgcgaucgacggcgaguaccggcugcgcggggaggcccggaagaccuucgucgaccugaugcgccggggcgaccuccccguguggcuggccuaccgcguggccgccgaggggaucaacuacgcggaccggcgcuggugcuucgacggcaucaagaacaaccagauccuggaggagaacgucgagguggagaucuggaccaaggagggggagcggaagaagcucaagccgcgcuggcuggacgcccggaucuacagcgacccccuggcccucaaggaguucaaggaguucgccgcgggccgcaagucccugacccugaaccucaucacggagaugggccggcugcccaccuucaugacccagaaggcccgcgacgcccuggacaaccucgccguccugcacaccgccgaggccggcgggcgggccuacaagcacgcccugagcgagcuccccgagacgcuggagacccugcuccugcugacccuccuggccaccgugaccggcgggaucuuccuguuccucauguccgggaaggggaucggcaagaugacccuggggaugugcugcaucaucaccgccagcauccugcucugguacgcgcagauccagccgcacuggaucgccgccuccaucauccuggaguucuuccugaucgugcuccugauccccgagcccgagaagcagcgcacgccccaggacaaccagcugaccuacgucgugaucgccauccucacgguggucgccgcgaccauggccaacgagaugggcuuccuggagaagaccaagaaggaccuggggcucggcagcaucaccacgcaggagagcgaguccaacauccuggacaucgaccugcggccggccagcgccuggacccucuacgccguggcgaccaccuucgugacgcccaugcugcgccacuccaucgagaacagcuccgucaacgugagccugaccgccaucgccaaccaggccaccgugcucaugggccuggggaagggcuggccccuguccaagauggacaucggggucccccuccuggcgaucggcugcuacagccaggugaacccgaucacccugacggccgcccuccugcugcucguggcccacuacgccaucaucgggcccggccugcaggcgaaggccacccgcgaggcccagaagcgggccgccgcgggcaucaugaagaaccccaccgucgacgggaucaccgugaucgaccuggagcccaucccguacgaccccaaguucgagaagcagcucggccaggugaugcugcugauccucugcgucacccaggugcugaugaugcgcaccaccugggcccugugcgaggcccucacccuggccacggggcccaucuccacccugugggagggcaaccccgggcgguucuggaacaccaccaucgccgugagcauggcgaacaucuuccgcggcuccuaccucgccggcgccgggcugcuguucagcaucaugaagaacacgaccaacacccggcgcggcaccgggaacaucggcgagacgcucggcgagaaguggaagucccggcugaacgcccugggcaagagcgaguuccagaucuacaagaaguccggcauccaggaggucgaccgcacccucgcgaaggaggggaucaagcggggcgagaccgaccaccacgccgugagccgcggguccgccaagcugcggugguucguggagcgcaacauggucaccccggagggcaaggugguggaccugggcugcgggcggggcggguggagcuacuacugcggcgggcucaagaacguccgcgaggugaagggccugacgaagggcgggcccggccacgaggagcccauccccauguccaccuacggguggaaccuggugcggcuccagagcggcgucgacguguucuucaccccgcccgagaagugcgacacccugcugugcgacaucggggagagcucccccaaccccacgaucgaggccggccgcacccuccgggugcugaaccuggccgagaacuggcucaacaacaacacccaguucugcaucaagguccugaacccguacaugcccagcgugaucgagaagauggagacccugcagcgcaaguacggcggggcgcuggugcggaacccccucucccgcaacagcacccacgagauguacugggucuccaacgccacgggcaacaucgugagcuccgugaacaugaucagccgcaugcugaucaaccgguucaccaugaagcacaagaaggccaccuacgagccggacgucgaccugggguccggcacccgcaacaucgggaucgagagcgagauccccaaccucgacaucaucggcaagcggaucgagaagaucaagcaggagcacgagacguccuggcacuacgaccaggaccaccccuacaagaccugggccuaccacggcagcuacgagaccaagcagaccggguccgccagcuccauggugaacggcgugguccgccugcugacgaagcccugggacguggugccgauggucacccagauggcgaugaccgacaccacgcccuucgggcagcagcggguguucaaggagaagguggacacccgcacccaggagcccaaggagggcaccaagaagcucaugcggaucacggccgaguggcuguggaaggagcugggcaagaagaagacgccccgcaugugcacccgggaggaguucacccgcaagguccggagcaacgccgcccucggggccaucuucacggacgagaacaaguggaaguccgcgcgcgaggccguggaggacagccgguucugggagcugguggaccgcgagcggaaccugcaccucgagggcaagugcgagaccugcgucuacaacaugauggggaagcgcgagaagaagcugggcgaguucgggaaggccaagggcucccgggccaucugguacauguggcugggcgcgcgcuuccucgaguucgaggcccugggguuccugaacgaggaccacugguucagccggggcaacagccucuccgggguggagggcgaggggcugcaccgccugggcuacauccuccgggacgucagcaagaaggagggcggggccauguacgccgacgacaccgccggcugggacacccgcaucacgcuggaggaccugaagaacgaggagauggugaccaaccacaugaagggggagcacaagaagcucgcggaggccaucuucaagcugaccuaccagaacaaggugguccgcgugcagcggccgacgccccgcggcacggugauggacaucaucucccggaaggaccagcgcgggagcggccaggucggcaccuacgggcugaacaccuucaccaacauggaggcccagcucauccggcagauggagggcgaggggaucuucaaguccauccagcaccugacggugaccgaggagaucgccgugcagaacuggcuggcccgcgucggccgggagcgccucagccggauggcgaucuccggcgacgacugcguggugaagccccuggacgaccgcuucgccagcgcccugaccgcccucaacgacauggggaagguccggaaggacauccagcagugggagcccucccgcggcuggaacgacuggacccaggugccguucugcagccaccacuuccacgagcuggugaugaaggacgggcggguccugguggugcccugccgcaaccaggacgagcucaucggccgggcccgcaucucccagggggcgggcuggagccugaaggagacggccugccugggcaaguccuacgcccagauguggacccucauguacuuccaccggcgcgaccugcggcuggccgccaacgcgaucugcagcgccguccccucccacugggugcccaccagccgcaccaccugguccauccacgccaagcacgaguggaugacgaccgaggacaugcucgccguguggaaccgcgucuggauccaggagaacccguggauggaggacaagacccccguggagagcugggaggaggugcccuaccuggggaagcgggaggaccaguggugcggcagccugaucgggcucaccucccgcgcgacgugggccaagaacauccagaccgccaucaaccagguccggagccugaucggcaacgaggaguacaccgacuacaugcccuccaugaagcgcuuccggcgcgaggaggaggaggccggggugcugugg

SEQ ID NO: 9736 - RNA, 9876 nt, Artificial Sequence
  derived and/or modified CDS sequence (opt1) from DENV-2__KU365901__SS-prME
accgccggcaucaucaucaugaugauccccaccgugauggccuuccaccugaccacccggaacggggagccccacaugaucgucagccggcaggagaagggcaagucccuccuguucaagaccgagaacggggugaacaugugcacccugauggcgauggaccucggcgagcugugcgaggacaccaucaccuacaacugcccccugcuccggcagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugccccacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccaggagcucaaccacauccuguccgagaacgaggucaagcugaccaucaugacgggggacaucaagggcaucaugcaggccgggaagcggagccuccgcccccagccgaccgagcugaaguacuccuggaagaccuggggcaaggcgaagaugcugagcaccgagcuccacaaccacacguuccugaucgacggccccgagaccgccgagugccccaacaccaaccgggccuggaacucccuggagguggaggacuacggguucggcguguucaccacgaacaucuggcucaagcugaaggagaagcaggacgucuucugcgacagcaagcugauguccgccgccaucaaggacaaccgcgcggugcacgccgacaugggguacuggaucgagagcgcccucaacgacaccuggaagaucgagaaggccuccuucaucgaggucaagagcugcaacuggccgaagucccacacccuguggagcaacggcgugcuggaguccgagaugaucauccccaagaacuucgccggccccgugagccagcacaacuaccggcccggguaccacacccagaccgcgggcccguggcaccucgggcgccuggagauggacuucgaguucugcgagggcacgaccguggucgugaccgaggacugcgggaaccggggccccagccugcgcaccacgaccgccuccggcaagcucaucaccgaguggugcugccggagcugcacccugccgccccugcgcuaccgcggggaggacggcugcugguacgggauggagauccgcccgcucaaggagaaggaggagaaccuggugaacucccuggucacggccggccacgggcagaucgacaacuucagccucggcgugcugggcauggcccuguuccucgaggagaugcugcggacccgcguggggaccaagcacgcgauccugcucgucgccgugaccuucgugacgcugaucaccggcaacauguccuuccgggaccuggggcgcgucauggugauggugggcgccaccaugaccgacgacaucgggaugggcgucacguaccucgcccugcuggccgcguucaaggugcgccccaccuucgccgccggccuccugcugcggaagcucaccagcaaggagcugaugauggccaccaucgggaucgugcugcucucccagagcacgauccccgagaccauccuggagcugaccgacgcccucgcgcugggcaugaugguccugaagaucgugcgcaacauggagaaguaccagcucgccgucaccaucauggccauccugugcgugcccaacgccgugauccugcagaacgccuggcgggucuccugcacgacccucgcgguggugagcgucuccccgcugcugcucaccagcucccagcagaaggccgacuggaucccccuggcccugaccaucaaggggcucaaccccacggccaucuuccugaccacccugagccgcaccuccaagaagcggagcuggccccucaacgaggcgaucauggccgugggcaugguguccauccuggccagcucccugcucaagaacgacaucccgaugacgggcccccuggucgccgggggccugcucaccgugugcuacgugcugaccgggcgcagcgccgaccuggagcucgagcgggcggccgacguccgcugggaggagcaggccgagaucagcggcuccagccccauccuguccaucaccaucagcgaggacggguccaugagcaucaagaacgaggaggaggagcagacgcugaccauccucauccggaccggccugcuggugaucuccggccucuuccccgugagcaucccgaucaccgccgccgcgugguaccugugggaggucaagaagcagcgcgccggggugcugugggacgugcccagcccgccgcccgucggcaaggccgagcucgaggacggggccuaccggaucaagcagaagggcauccugggguacagccagaucggcgccggcguguacaaggaggggaccuuccacacgauguggcacgugacccgcggcgcgguccugaugcacaaggggaagcggaucgagcccuccugggccgacgugaagaaggaccucaucagcuacggcgggggcuggaagcuggagggcgaguggaaggagggggaggaggugcagguccuggcccucgagcccggcaagaacccccgcgccgugcagaccaagcccgggcuguucaagaccaacacgggcaccaucggggccgugucccuggacuucagccccggcaccuccggcagccccaucgucgacaagaaggggaagguggugggccucuacgggaacggcgucgugacccgguccggcacguacgugagcgcgaucgcccagaccgagaaguccaucgaggacaacccggagaucgaggacgacaucuuccgcaagaagcggcugaccaucauggaccugcaccccggggccggcaagaccaagcgcuaccugcccgccaucguccgggaggcgaucaagcgcgggcuccggacgcugauccuggcccccacccgcgugguggccgccgagauggaggaggcccuccgcggccugccgauccgguaccagacccccgcgauccgcgccgagcacaccgggcgggagaucgucgaccugaugugccacgccacguucaccaugcgccuccugagccccauccgggugcccaacuacaaccugaucaucauggacgaggcccacuucaccgacccggccagcaucgcggcccgcggcuacaucuccacccggguggagaugggcgaggccgccgggaucuucaugacggccacgccgcccggcagccgcgaccccuucccgcaguccaacgcgcccaucauggacgaggagcgggagauccccgagcgcagcuggaacuccgggcacgagugggucaccgacuucaagggcaagaccgugugguucgugcccagcaucaaggccgggaacgacaucgccgccugccuccggaagaacggcaagaaggucauccagcugucccgcaagacguucgacagcgaguacaucaagacccggaccaacgacugggacuucguggugaccacggacaucuccgagaugggcgcgaacuucaaggccgagcgcgucaucgacccgcggcgcugcaugaagcccgugauccugaccgacggggaggagcgggugauccucgccggccccaugcccgucacccacagcuccgccgcccagcgccgggggcgcgugggccgcaacccgaagaacgagaacgaccaguacaucuacaugggggagccccuggagaacgacgaggacugcgcgcacuggaaggaggccaagaugcugcucgacaacaucaacacccccgagggcaucauccccagcauguucgagccggagcgggagaagguggacgccaucgacggcgaguaccgccugcgcggggaggcccgcaagacguucgucgaccugaugcggcgcggcgaccuccccguguggcuggccuaccgggucgcggccgaggggaucaacuacgccgaccgccgguggugcuucgacggcgugaagaacaaccagauccuggaggagaacguggaggucgagaucuggaccaaggagggggagcgcaagaagcucaagccccgguggcuggacgcccgcaucuacuccgacccgcuggcccucaaggaguucaaggaguucgcggccggccgcaagagccugacccugaaccucaucaccgagaugggccggcugcccacguucaugacccagaaggcccggaacgcccuggacaaccucgcggugcugcacaccgccgaggccgggggccgcgccuacaaccacgcccuguccgagcuccccgagacccuggagacgcugcuccugcugacccuccuggcgaccgugaccgggggcaucuuccuguuccucaugagcggcaaggggaucggcaagaugacccuggggaugugcugcaucaucacggccuccauccugcucugguacgcccagauccagccccacuggaucgccgccagcaucauccuggaguucuuccugaucguccuccugaucccggagcccgagaagcagcggacgccccaggacaaccagcugaccuacguggugaucgcgauccucaccgucguggccgccacgauggccaacgagaugggcuuccuggagaagaccaagaaggacuucgggcugggcuccaucaccacccagcagcccgagagcaacauccucgacaucgaccugcgcccggccagcgcguggacgcuguacgccguggccaccaccuucaucacccccaugcuccggcacuccaucgagaacagcuccgucaacgugagccugacggccaucgccaaccaggcgaccgugcugaugggccucgggaagggcuggccccuguccaagauggacaucggggucccccugcucgccaucggcugcuacagccaggugaacccgaucacccugaccgccgcccugcuccugcugguggcgcacuacgccaucaucgggcccggccuccaggccaaggccacgcgcgaggcccagaagcgggcggccgccggcaucaugaagaaccccaccgucgacgggaucaccgugaucgaccuggaccccaucccguacgaccccaaguucgagaagcagcugggccaggugaugcuccugguccugugcgugacccaggugcucaugaugcgcacgaccugggcccugugcgaggcccugacccucgcgaccgggcccaucuccacgcugugggagggcaaccccgggcgcuucuggaacaccaccaucgccgucagcauggccaacaucuuccggggcuccuaccuggccggcgccgggcuccuguucagcaucaugaagaacaccgcgaacacgcgccggggcaccgggaacaccggcgagacccugggcgagaaguggaagaaccgccucaacgcccuggggaaguccgaguuccagaucuacaagaaguccggcauccaggagguggaccggacgcuggccaaggaggggaucaagcgcggcgagaccgaccaccacgccgugucccgggggagcgcgaagcuccgcugguucgucgagcggaaccuggugaccccggagggcaagguggucgaccugggcugcgggcgcggcgggugguccuacuacugcggcgggcucaagaacgugaaggaggugaagggccugaccaagggcgggcccggccacgaggagcccauccccaugagcacguacggguggaaccugguccggcuccaguccggcguggacguguucuucaccccgcccgagaagugcgacacccugcugugcgacaucggggagagcucccccaaccccaccgucgaggccggccgcacccuccgggugcugaaccugguggagaacuggcucaacaacaacacgcaguucugcaucaagguccugaacccguacaugcccagcgugaucgagaagauggaggcccugcagcgcaaguacggcggggcccuggugcggaacccccucagccgcaacuccacccacgagauguacugggucagcaacgccuccggcaacaucgugagcuccgugaacaugaucagccggaugcugaucaaccgcuucaccaugcggcacaagaaggcgaccuacgagccggacgucgaccugggguccggcacgcgcaacaucgggaucgagagcgagacccccaaccucgacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgugguccggcugcugaccaagcccugggacgugaucccgauggugacccagauggccaugacggacaccacccccuucgggcagcagcgcgucuucaaggagaagguggacacccggacgcaggagcccaaggagggcaccaagaagcucaugaagaucaccgccgaguggcuguggaaggagcugggccgcaagaagacgccccggaugugcacgcgcgaggaguucacccggaagguccgcagcaacgcggcccucggggccaucuucaccgacgagaacaaguggaaguccgcccgggaggccguggaggacagcggcuucugggagcugguggacaaggagcgcaaccugcaccucgaggggaagugcgagaccugcgucuacaacaugaugggcaagcgggagaagaagcugggggaguucggcaaggcgaagggcucccgcgccaucugguacauguggcugggggcccgguuccucgaguucgaggcccugggcuuccugaacgaggaccacugguucagccgcgagaacucccucagcgggguggagggcgaggggcugcacaagcugggcuacauccuccgggacgugagcaagaaggagggcggggcgauguacgccgacgacacggccggcugggacacccgcaucacccuggaggaccugaagaacgaggagauggucaccaaccacauggagggggagcacaagaagcucgccgaggccaucuucaagcugacguaccagaacaagguggugcggguccagcgcccgacgccccggggcaccgugauggacaucaucucccgccgggaccagcgcgggagcggccagguggucaccuacggccugaacaccuucaccaacauggaggcgcagcucauccgccagauggagggggagggcguguucaaguccauccagcagcugaccgugaccgaggagaucgccgucaagaacuggcuggcccggguggggcgcgagcggcucagccgcauggccaucuccggcgacgacugcguggucaagccccuggacgaccgguucgccagcgcgcugacggcccucaacgacaugggcaaggugcgcaaggacauccagcagugggagcccucccggggguggaacgacuggacccaggugccguucugcagccaccacuuccacgagcugaucaugaaggacggccgcguccugguggugcccugccggaaccaggacgagcucaucgggcgcgcccggaucucccagggcgccggguggagccugcgcgagaccgccugccugggcaaguccuacgcgcagauguggagccucauguacuuccaccggcgcgaccugcggcuggccgccaacgccaucugcuccgccguccccagccacugggugcccaccucccgcaccacguggagcauccacgcgacccacgaguggaugaccaccgaggacaugcucacgguguggaaccgggucuggauccaggagaacccguggauggaggacaagacccccguggaguccugggaggagauccccuaccugggcaagcgcgaggaccaguggugcgggagccugaucggccucaccagccgggccaccugggccaagaacauccagacggccaucaaccaggugcgcucccugaucgggaacgaggaguacaccgacuacaugcccagcaugaagcgcuuccggcgcgaggaggaggaggcgggcguccugugguga

SEQ ID NO: 9737 - RNA, 9876 nt, Artificial Sequence
  derived and/or modified CDS sequence (opt1) from DENV-2__GQ398258__SS-prME
accgccgggaugaucaucaugcugauccccaccgugauggccuuccaccucaccacccgcaacggggagccccacaugaucgugagccggcaggagaagggcaagagccugcuguucaagaccgaggacggggugaacaugugcacccucauggcgauggaccugggcgagcugugcgaggacaccaucaccuacaacugcccccuccugcgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcucgagacccgcaccgagaccuggauguccagcgagggcgccuggaagcacgcccagcggaucgagaccuggauccugcgccaccccggguucaccaucauggcggccauccuggccuacaccaucggcaccaccuacuuccagcggguccucaucuucauccugcugacggccguggcgcccuccaugaccaugcgcugcaucgggaucagcaaccgggacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccgcaaguacugcaucgaggccaagcugaccaacacgaccaccgcgagccggugccccacccagggggagcccucccugaacgaggagcaggacaagcgcuucgugugcaagcacagcaugguggaccggggcuggggcaacgggugcggccucuucgggaagggcgggaucgucacgugcgccauguucacgugcaagaagaacauggagggcaagguggugcagcccgagaaccuggaguacaccaucgucaucacgccccacuccggcgaggagaacgccguggggaacgacacgggcaagcacgggaaggagaucaagaucaccccgcagagcuccaucaccgaggccgagcugaccggcuacgggaccgugacgauggagugcagcccccgcaccggccucgacuucaacgagaugguccugcugcagauggagaacaaggccuggcucgugcaccggcagugguuccuggaccugccccuccccuggcugccgggcgcggacacccagggguccaacuggauccagaaggagacccuggugacguucaagaacccccacgccaagaagcaggacgucgugguccucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaagguggugaaggagaucgcggagacccagcacggcaccaucgucauccgcgugcaguacgagggggacggcagccccugcaagauccccuucgagaucauggaccuggagaagcggcacgugcucggccgccugaucacggucaacccgaucgugaccgagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgccaagcggauggccauccugggcgacacggccugggacuucgggucccugggcgggguguucaccagcaucggcaaggcgcuccaccagguguucggggccaucuacggcgccgccuucuccggcgucagcuggaccaugaagauccugaucgggguggugaucaccuggaucggcaugaacucccgcagcacgucccugagcgucucccuggugcucgugggggucgugacccuguaccugggcgugaugguccaggcggacagcgggugcgugguguccuggaagaacaaggagcucaagugcggcagcggcaucuucaucaccgacaacguccacaccuggacggagcaguacaaguuccagcccgagagccccuccaagcuggccagcgccauccagaaggcccacgaggaggggaucugcggcauccgguccgugacccgccuggagaaccucauguggaagcagaucacccccgagcugaaccacauccugagcgagaacgaggugaagcucaccaucaugacgggggacaucaagggcaucaugcaggccgggaagcggucccugcgcccgcagcccaccgagcugaaguacagcuggaagaccuggggcaaggcgaagaugcucuccaccgagcugcacaaccagacguuccugaucgacggccccgagaccgccgagugcccgaacaccaaccgggccuggaacagccucgaggucgaggacuacggguucggcguguucaccacgaacaucuggcugaagcugaaggagcgccaggacguguucugcgaccccaagcucauguccgccgccaucaaggacaaccgggcgguccacgccgacaugggguacuggaucgagagcgcccugaacgacaccuggaagaucgagaaggccuccuucaucgaggucaagagcugccacuggcccaagucccacacccuguggagcaacggcgugcucgaguccgagaugaucauccccaagaacuucgccggcccggugagccagcacaacuaccgccccggguaccacacccagaccgcgggccccuggcaccuggggaagcuggagauggacuucgacuucugcgagggcacgaccgugguggucaccgaggacugcgggaaccggggccccucccuccgcaccacgaccgccagcggcaagcugaucaccgaguggugcugccggagcugcacccugccgccccuccgcuacaagggggaggacggcugcugguacgggauggagauccggccccugaaggagaaggaggagaaccuggugaacucccucgugacggccggccacgggcagaucgacaacuucagccugggcguccugggcauggcccucuuccuggaggagaugcugcgcacccggguggggaccaagcacgcgauccuccugguggccgucuccuucgugacccugaucacgggcaacaugagcuuccgcgaccucgggcgggugauggucauggugggcgccaccaugaccgacgacaucgggaugggcgugaccuaccuggcccugcucgccgcguucaagguccgccccacguucgccgccggccugcugcuccgcaagcugaccuccaaggagcugaugaugaccaccaucgggaucgugcuccugagccaguccacgaucccggagaccauccuggagcucaccgacgcccuggcccugggcaugauggugcucaagaucgucaagaacauggagaaguaccagcuggcggugaccaucauggccauccugugcguccccaacgccgugauccuccagaacgccuggaaggugagcugcacgauccuggccgucguguccgugagcccccugcuccugaccuccagccagcagaaggcggacuggaucccccuggcccucaccaucaaggggcugaacccgaccgccaucuuccugacgacccucucccggaccagcaagaagcgcuccuggccccugaacgaggccaucauggcggucggcauggugagcauccuggccuccagccuccugaagaacgacauccccaugaccggcccccugguggccgggggccuccugacggucugcuacgugcugaccgggcgguccgccgaccucgagcuggagcgcgccgcggacgugcggugggaggaccaggccgagaucagcggcagcuccccgauccugagcaucaccaucuccgaggacgggagcauguccaucaagaacgaggaggaggagcagacccucacgauccugauccgcaccggccugcucgucaucagcggccuguuccccguguccauccccaucaccgccgccgccugguaccugugggaggugaagaagcagcgggcggggguccucugggacgugcccagcccgccgcccgugggcaaggccgagcuggaggacggggccuaccgcaucaagcagaagggcauccugggguacucccagaucggcgccggcgucuacaaggaggggaccuuccacaccauguggcacgugacgcggggcgccgugcucaugcacaaggggaagcgcaucgagccgagcugggcggacgucaagaaggaccugaucuccuacggcgggggcuggaagcuggagggcgaguggaaggagggggaggagguccaggugcucgcccuggagcccggcaagaacccccgggccguccagaccaagcccgggcuguucaagaccaacaccggcacgaucggggccgugagccucgacuucuccccgggcaccagcggcucccccaucguggacaagaaggggaaggucgugggccuguacgggaacggcguggucacccgcagcggcaccuacguguccgccaucgcgcagacggagaaguccaucgaggacaaccccgagaucgaggacgacaucuuccggaagaagcgccugaccaucauggaccugcaccccggggccggcaagaccaagcgguaccucccggccaucgugcgcgaggccaucaagcgggggcugcgcacccugauccucgcgcccacgcgggucguggccgccgagauggaggaggcccugcgcggccugcccauccgguaccagacccccgccauccgcgcggagcacaccgggcgcgagaucguggaccucaugugccacgccaccuucacgaugcggcugcuguccccgguccgcgugcccaacuacaaccucaucaucauggacgaggcccacuucaccgaccccgccagcaucgccgcgcggggcuacaucagcacccgcguggagaugggcgaggccgccgggaucuucaugaccgccacgcccccgggcucccgggaccccuucccccagagcaacgcccccaucauggacgaggagcgcgagaucccggagcgguccuggaacagcgggcacgagugggucaccgacuucaagggcaagaccgugugguucgugcccuccaucaaggcggggaacgacaucgccgccugccugcgcaagaacggcaagaaggucauccagcugagccggaagaccuucgacuccgaguacaucaagacgcgcaccaacgacugggacuucguggugaccaccgacaucagcgagaugggcgccaacuucaaggcggagcgggucaucgacccccgccggugcaugaagcccgugauccucacggacggggaggagcgcgugauccuggccggcccgaugcccgucacccacuccagcgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacaccccggagggcaucauccccuccauguucgagcccgagcgggagaagguggacgccaucgacggcgaguaccgccugcgcggggaggcccggaagaccuucguggaccucaugcgccggggcgaccugccggucuggcuggccuaccgcguggccgcggaggggaucaacuacgccgaccggcgcuggugcuucgacggcaucaagaacaaccagauccucgaggagaacgucgagguggagaucuggacgaaggagggggagcggaagaagcugaagccccgcuggcuggacgcccggaucuacagcgacccccucgcccugaaggaguucaaggaguucgccgcgggccgcaagucccugacccucaaccugaucaccgagaugggccggcugcccaccuucaugacgcagaaggcccgcaacgcccucgacaaccuggccgugcugcacaccgcggaggccgggggccgggccuacaaccacgcccucagcgagcugccggagacccuggagacccuccugcugcucacgcugcuggccaccgucaccgggggcaucuuccucuuccugauguccggcaaggggaucggcaagaugacccuggggaugugcugcaucaucaccgcgagcauccuccugugguacgcccagauccagccccacuggaucgccgccuccaucauccuggaguucuuccucaucgugcugcugauccccgagcccgagaagcagcgcacgccgcaggacaaccagcucaccuacguggucaucgccauccugaccgugguggcggccaccauggccaacgagaugggcuuccuggagaagacgaagaaggacuucgggcucggcagcaucgccacccaccagcccgaguccaacauccuggacaucgaccugcggcccgccagcgcguggacccucuacgccgucgccaccacguucaucacccccaugcugcgccacagcaucgagaacuccagcgugaacgugucccugaccgccaucgccaaccaggcgaccguccucaugggccuggggaagggcuggccgcugagcaagauggacaucggggugccccuccuggccaucggcugcuacucccaggugaaccccaucacgcugaccgccgcccuccugcugcucgucgcgcacuacgccaucaucgggcccggccugcaggccaaggccacccgggaggcccagaagcgcgcggccgccggcaucaugaagaacccgaccguggacgggaucacggugaucgaccuggaccccauccccuacgaccccaaguucgagaagcagcucggccaggucaugcugcuggugcucugcgugacccagguccugaugaugcggaccaccugggcccugugcgaggcccucacgcuggcgaccgggccgaucagcacccugugggagggcaaccccgggcgcuucuggaacaccacgaucgccguguccauggccaacaucuuccggggcagcuaccucgccggcgccgggcugcuguucuccaucaugaagaacaccgcgaacacccgccgcggcaccgggaacacgggcgagacccucggcgagaaguggaagaaccggcugaacgcccugggcaagagcgaguuccagaucuacaagaaguccggcauccaggagguggaccgcacccucgccaaggaggggaucaagcggggcgagaccgaccaccacgccgucagccgcggguccgcgaagcugcggugguucguggagcgcaaccuggugacgcccgagggcaaggucguggaccucggcugcgggcggggcggguggagcuacuacugcggcgggcugaagaacgugcgcgaggucaagggccugaccaagggcgggcccggccacgaggagccgauccccauguccaccuacggguggaaccucgugcggcugcagagcggcguggacgucuucuucacgccgcccgagaagugcgacacgcugcucugcgacaucggggaguccagcccgaaccccaccguggaggccggccgcacccugcgggugcugaaccucgucgagaacuggcugaacaacaacacccaguucugcaucaaggugcugaaccccuacaugccguccgugaucgagaagauggaggcccugcagcgcaaguacggcggggcccucguccggaacccccugagccgcaacagcacccacgagauguacuggguguccaacgccagcggcaacaucguguccagcgucaacaugaucucccggaugcugaucaaccgcuucacgaugcggcacaagaaggcgaccuacgagcccgacguggaccucgggagcggcacccgcaacaucgggaucgaguccgagacccccaaccuggacaucaucggcaagcggaucgagaagaucaagcaggagcacgagacgagcuggcacuacgaccaggaccacccguacaagaccugggccuaccacggcuccuacgagaccaagcagaccgggagcgccuccagcauggugaacggcgucgugcgccugcucacgaagcccugggacgugauccccauggucacccagauggccaugaccgacaccacgcccuucgggcagcagcgcguguucaaggagaagguggacacccggacccaggagccgaaggagggcaccaagaagcugaugaagaucacggccgaguggcuguggaaggagcucggcaagaagaagacgccccgcaugugcacccgggaggaguucacccgcaagguccgguccaacgcggcccugggggccaucuucacggacgagaacaaguggaaguccgcccgcgaggccguggaggacucccgguucugggagcuggucgacaaggagcgcaaccuccaccuggagggcaagugcgagaccugcguguacaacaugauggggaagcgggagaagaagcugggcgaguucgggaaggcgaagggcagccgcgccaucugguacauguggcucggcgcccgguuccuggaguucgaggcccugggguuccucaacgaggaccacugguucucccgcgagaacagccuguccggcguggagggggagggccugcacaagcucggguacauccugcgggacgucagcaagaaggagggcggcgcgauguacgccgacgacaccgccgggugggacacccgcaucacgcuggaggaccucaagaacgaggagauggugaccaaccacauggagggcgagcacaagaagcuggccgaggccaucuucaagcugaccuaccagaacaaggugguccgggugcagcgccccacgccccgggggacggugauggacaucaucagccgccgggaccagcgcggcuccgggcaggucggcaccuacggccucaacaccuucaccaacauggaggcgcagcugauccggcagauggagggggagggcguguucaagagcauccagcaccugacggugaccgaggagaucgccguccagaacuggcucgcccgcguggggcgcgagcggcugucccgcauggccaucagcggcgacgacugcguggucaagccgcuggacgaccgguucgccuccgcgcucaccgcccugaacgacaugggcaaggugcgcaaggacauccagcagugggagcccagccggggguggaacgacuggacccaggugcccuucugcucccaccacuuccacgagcugaucaugaaggacggccgcguccucguggugcccugccggaaccaggacgagcugaucgggcgcgcccggaucagccagggcgccggguggucccugcgcgagacggccugccucggcaagagcuacgcgcagauguggucccugauguacuuccaccggcgcgaccugcggcucgccgccaacgccaucugcagcgccgucccgucccacugggugcccaccagccgcaccaccugguccauccacgcgcggcacgaguggaugaccacggaggacaugcugaccguguggaaccgcgucugggugcaggagaaccccuggauggaggacaagacccccguggagagcugggaggagaucccguaccugggcaagcgggaggaccaguggugcgggucccucaucggccugaccagccgcgccacgugggccaagaacauccagaccgccaucaaccagguccggagccugaucgggaacgaggaguacaccgacuacaugcccuccaugaagcgcuuccgccgggaggaggaggaggcgggcgugcucugguga

SEQ ID NO: 9738 - RNA, 9876 nt, Artificial Sequence
  derived and/or modified CDS sequence (opt1) from DENV-2__GQ398259__SS-prME
accgccggcaugaucaucaugcugauccccaccgugauggccuuccaccucaccacccgcaacggggagccccacaugaucgugucccggcaggagaagggcaagucccugcuguucaagaccgaggacggggugaacaugugcacccucauggcgauggaccugggcgagcugugcgaggacaccaucaccuacaacugcccccuccugcgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcucgagacccgcaccgagaccuggauguccagcgagggcgccuggaagcacgcccagcggaucgagaccuggauccugcgccaccccggguucacgaucauggcggccauccuggccuacaccaucggcaccaccuacuuccagcggguccucaucuucauccugcugacggccguggcgcccuccaugaccaugcgcugcaucgggaucagcaaccgggacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccgcaaguacugcaucgaggccaagcugaccaacacgaccaccgcgagccggugcccgacccagggggagcccucccugaacgaggagcaggacaagcgcuucgugugcaagcacagcaugguggaccggggcuggggcaacgggugcggccucuucgggaagggcgggaucgucacgugcgccauguucacgugcaagaagaacauggagggcaagguggugcagcccgagaaccuggaguacaccaucgucaucacgccccacuccggcgaggagaacgccguggggaacgacacgggcaagcacgggaaggagaucaagaucaccccgcagagcuccaucaccgaggccgagcugaccggcuacgggaccgugacgauggagugcagcccccgcaccggccucgacuucaacgagaugguccugcugcagauggagaacaaggccuggcucgugcaccggcagugguuccuggaccugccccuccccuggcugccgggcgcggacacccagggguccaacuggauccagaaggagacccuggugacguucaagaacccccacgccaagaagcaggacgucgugguccucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaagguggugaaggagaucgcggagacccagcacggcaccaucgucauccgcgugcaguacgagggggacggcagccccugcaagauccccuucgagaucauggaccuggagaagcggcacgugcucggccgccugaucacggucaacccgaucgugaccgagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgccaagcggauggccauccugggcgacacggccugggacuucgggucccugggcgggguguucaccagcaucggcaaggcgcuccaccagguguucggggccaucuacggcgccgccuucuccggcgucagcuggaccaugaagauccugaucgggguggugaucaccuggaucggcaugaacucccgcagcacgucccugagcgucucccuggugcucgugggggucgugacccuguaccugggcgugaugguccaggcggacagcgggugcgugguguccuggaagaacaaggagcucaagugcggcagcggcaucuucaucaccgacaacguccacaccuggacggagcaguacaaguuccagcccgagagccccuccaagcuggccagcgccauccagaaggcccacgaggaggggaucugcggcauccgguccgugacccgccuggagaaccucauguggaagcagaucacccccgagcugaaccacauccugagcgagaacgaggugaagcucaccaucaugacgggggacaucaagggcaucaugcaggccgggaagcggucccugcgcccgcagcccaccgagcugaaguacagcuggaagaccuggggcaaggcgaagaugcucuccaccgagcugcacaaccagacguuccugaucgacggccccgagaccgccgagugcccgaacaccaaccgggccuggaacagccucgaggucgaggacuacggguucggcguguucaccacgaacaucuggcugaagcugaaggagcgccaggacguguucugcgacuccaagcucaugagcgccgccaucaaggacaaccgggcgguccacgccgacaugggguacuggaucgaguccgcccugaacgacaccuggaagaucgagaaggccagcuucaucgaggugaaguccugccacuggcccaagagccacacccugugguccaacggcgugcucgagagcgagaugaucauccccaagaacuucgccggccccgucucccagcacaacuaccgcccgggguaccacacccagaccgcgggccccuggcaccuggggaagcuggagauggacuucgacuucugcgagggcacgaccgugguggucaccgaggacugcgggaaccggggccccagccuccgcaccacgaccgccagcggcaagcugaucaccgaguggugcugccgguccugcacccugcccccgcuccgcuacaagggggaggacggcugcugguacgggauggagauccggccccugaaggagaaggaggagaaccuggugaacagccucgugacggccggccacgggcagaucgacaacuucucccugggcguccugggcauggcccucuuccuggaggagaugcugcgcacccggguggggaccaagcacgcgauccuccugguggccgucagcuucgugacccugaucacgggcaacauguccuuccgcgaccucgggcgggugauggucauggugggcgccaccaugaccgacgacaucgggaugggcgugaccuaccuggcccugcucgccgcguucaagguccgccccacguucgccgccggccugcugcuccgcaagcugaccagcaaggagcugaugaugaccaccaucgggaucgugcuccugucccagagcacgauccccgagaccauccuggagcucaccgacgcccuggcccugggcaugauggugcucaagaucgucaagaacauggagaaguaccagcuggcggugaccaucauggccauccugugcgucccgaacgccgugauccuccagaacgccuggaagguguccugcacgauccuggccgucgugagcgugagcccccugcuccugaccagcucccagcagaaggcggacuggaucccccuggcccucaccaucaaggggcugaaccccaccgccaucuuccugacgacccucagccggaccuccaagaagcgcagcuggccgcugaacgaggccaucauggcggucggcaugguguccauccuggccagcucccuccugaagaacgacauccccaugaccggcccccugguggccgggggccuccugacggucugcuacgugcugaccgggcggagcgccgaccucgagcuggagcgcgccgcggacgugcggugggaggaccaggccgagaucagcggcuccagccccauccuguccaucaccaucagcgaggacggguccaugagcaucaagaacgaggaggaggagcagacccucacgauccugauccgcaccggccugcucgucaucuccggccuguucccggugagcauccccaucaccgccgccgccugguaccugugggaggugaagaagcagcgggcggggguccucugggacgugcccagcccgccgcccgugggcaaggccgagcuggaggacggggccuaccgcaucaagcagaagggcauccugggguacagccagaucggcgccggcgucuacaaggaggggaccuuccacaccauguggcacgugacgcggggcgccgugcucaugcacaaggggaagcgcaucgagcccuccugggcggacgucaagaaggaccugaucagcuacggcgggggcuggaagcuggagggcgaguggaaggagggggaggagguccaggugcucgcccuggagcccggcaagaacccccgggccguccagaccaagcccgggcuguucaagaccaacaccggcacgaucggggccgugucccucgacuucagccccggcaccuccggcagccccaucguggacaagaaggggaaggucgugggccuguacgggaacggcguggucacccgcuccggcaccuacgugagcgccaucgcgcagacggagaaguccaucgaggacaaccccgagaucgaggacgacaucuuccggaagaagcgccugaccaucauggaccugcaccccggggccggcaagaccaagcgguaccuccccgccaucgugcgcgaggccaucaagcgggggcugcgcacccugauccucgcgccgacgcgggucguggccgccgagauggaggaggcccugcgcggccugcccauccgguaccagacccccgccauccgcgcggagcacaccgggcgcgagaucguggaccucaugugccacgccaccuucacgaugcggcugcugagccccguccgcgugccgaacuacaaccucaucaucauggacgaggcccacuucaccgaccccgccagcaucgccgcgcggggcuacaucuccacccgcguggagaugggcgaggccgccgggaucuucaugaccgccacgccgcccggcagccgggacccguucccccaguccaacgcccccaucauggacgaggagcgcgagauccccgagcggagcuggaacuccgggcacgagugggucaccgacuucaagggcaagaccgugugguucgugccgagcaucaaggcggggaacgacaucgccgccugccugcgcaagaacggcaagaaggucauccagcugucccggaagaccuucgacagcgaguacaucaagacgcgcaccaacgacugggacuucguggugaccaccgacaucuccgagaugggcgccaacuucaaggcggagcgggucaucgacccccgccggugcaugaagcccgugauccucacggacggggaggagcgcgugauccuggccggccccaugccggucacccacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacccccgagggcaucaucccgagcauguucgagcccgagcgggagaagguggacgccaucgacggcgaguaccgccugcgcggggaggcccggaagaccuucguggaccucaugcgccggggcgaccugcccgucuggcuggccuaccgcguggccgcggaggggaucaacuacgccgaccggcgcuggugcuucgacggcaucaagaacaaccagauccucgaggagaacgucgagguggagaucuggacgaaggagggggagcggaagaagcugaagccgcgcuggcuggacgcccggaucuacuccgacccccucgcccugaaggaguucaaggaguucgccgcgggccgcaagagccugacccucaaccugaucaccgagaugggccggcugcccaccuucaugacgcagaaggcccgcaacgcccucgacaaccuggccgugcugcacaccgcggaggccgggggccgggccuacaaccacgcccucuccgagcugcccgagacccuggagacccuccugcugcucacgcugcuggccaccgucaccgggggcaucuuccucuuccugaugagcggcaaggggaucggcaagaugacccuggggaugugcugcaucaucaccgcguccauccuccugugguacgcccagauccagccgcacuggaucgccgccagcaucauccuggaguucuuccucaucgugcugcugauccccgagcccgagaagcagcgcacgccccaggacaaccagcucaccuacguggucaucgccauccugaccgugguggcggccaccauggccaacgagaugggcuuccuggagaagacgaagaaggacuucgggcucggcuccaucgccacccaccagccggagagcaacauccuggacaucgaccugcggcccgccagcgcguggacccucuacgccgucgccaccacguucaucacccccaugcugcgccacuccaucgagaacagcuccgugaacgugagccugaccgccaucgccaaccaggcgaccguccucaugggccuggggaagggcuggccccuguccaagauggacaucggggugccgcuccuggccaucggcugcuacagccaggugaaccccaucacgcugaccgccgcccuccugcugcucgucgcgcacuacgccaucaucgggcccggccugcaggccaaggccacccgggaggcccagaagcgcgcggccgccggcaucaugaagaaccccaccguggacgggaucacggugaucgaccuggacccgauccccuacgaccccaaguucgagaagcagcucggccaggucaugcugcuggugcucugcgugacccagguccugaugaugcggaccaccugggcccugugcgaggcccucacgcuggcgaccgggcccaucuccacccugugggagggcaacccggggcgcuucuggaacaccacgaucgccgugagcauggccaacaucuuccggggcuccuaccucgccggcgccgggcugcuguucagcaucaugaagaacaccgcgaacacccgccgcggcaccgggaacacgggcgagacccucggcgagaaguggaagaaccggcugaacgcccuggggaaguccgaguuccagaucuacaagaaguccggcauccaggagguggaccgcacccucgccaaggaggggaucaagcggggcgagaccgaccaccacgccgucucccgcgggagcgcgaagcugcggugguucguggagcgcaaccuggugacgcccgagggcaaggucguggaccucggcugcgggcggggcgggugguccuacuacugcggcgggcugaagaacgugcgcgaggucaagggccugaccaagggcgggcccggccacgaggagcccaucccgaugagcaccuacggguggaaccucgugcggcugcaguccggcguggacgucuucuucacgccgcccgagaagugcgacacgcugcucugcgacaucggggagagcucccccaacccgaccguggaggccggccgcacccugcgggugcugaaccucgucgagaacuggcugaacaacaacacccaguucugcaucaaggugcugaaccccuacaugcccagcgugaucgagaagauggaggcccugcagcgcaaguacggcggggcccucguccggaacccgcugagccgcaacuccacccacgagauguacugggugagcaacgccuccggcaacaucgugagcuccgucaacaugaucagccggaugcugaucaaccgcuucacgaugcggcacaagaaggcgaccuacgagcccgacguggaccucggguccggcacccgcaacaucgggaucgagagcgagacccccaaccuggacaucaucggcaagcggaucgagaagaucaagcaggagcacgagacguccuggcacuacgaccaggaccaccccuacaagaccugggccuaccacggcagcuacgagaccaagcagaccggguccgccagcuccauggugaacggcgucgugcgccugcucacgaagccgugggacgugauccccauggucacccagauggccaugaccgacaccacgcccuucgggcagcagcgcguguucaaggagaagguggacacccggacccaggagcccaaggagggcaccaagaagcugaugaagaucacggccgaguggcuguggaaggagcucggcaagaagaagaccccgcgcaugugcacccgggaggaguucacccgcaagguccggagcaacgcggcccugggggccaucuucacggacgagaacaaguggaaguccgcccgcgaggccguggaggacagccgguucugggagcuggucgacaaggagcgcaaccuccaccuggagggcaagugcgagaccugcguguacaacaugauggggaagcgggagaagaagcugggcgaguucgggaaggcgaagggcucccgcgccaucugguacauguggcucggcgcccgguuccuggaguucgaggcccugggguuccucaacgaggaccacugguucagccgcgagaacucccugagcggcguggagggggagggccugcacaagcucggguacauccugcgggacgucagcaagaaggagggcggcgcgauguacgccgacgacaccgccgggugggacacccgcaucacgcuggaggaccucaagaacgaggagauggugaccaaccacauggagggcgagcacaagaagcuggccgaggccaucuucaagcugaccuaccagaacaaggugguccgggugcagcgccccacgccccgggggacggugauggacaucaucucccgccgggaccagcgcggcagcgggcaggucggcaccuacggccucaacaccuucaccaacauggaggcgcagcugauccggcagauggagggggagggcguguucaaguccauccagcaccugacggugaccgaggagaucgccguccagaacuggcucgcccgcguggggcgcgagcggcugagccgcauggccaucuccggcgacgacugcguggucaagccccuggacgaccgguucgccagcgcgcucaccgcccugaacgacaugggcaaggugcgcaaggacauccagcagugggagccgucccggggguggaacgacuggacccaggugcccuucugcagccaccacuuccacgagcugaucaugaaggacggccgcguccucguggugcccugccggaaccaggacgagcugaucgggcgcgcccggaucucccagggcgccggguggagccugcgcgagacggccugccucggcaaguccuacgcgcagauguggagccugauguacuuccaccggcgcgaccugcggcucgccgccaacgccaucugcuccgccguccccagccacugggugccgaccucccgcaccaccuggagcauccacgcgcggcacgaguggaugaccacggaggacaugcugaccguguggaaccgcgucugggugcaggagaaccccuggauggaggacaagacccccguggaguccugggaggagauccccuaccugggcaagcgggaggaccaguggugcgggagccucaucggccugaccagccgcgccacgugggccaagaacauccagaccgccaucaaccagguccggucccugaucgggaacgaggaguacaccgacuacaugccgagcaugaagcgcuuccgccgggaggaggaggaggcgggcgugcucugguga

SEQ ID NO: 9739 - RNA, 9876 nt, Artificial Sequence
  derived and/or modified CDS sequence (opt1) from DENV-2__GQ398268__SS-prME
accgccggcaugaucaucaugcugauccccaccgugauggccuuccaccucaccacccggaacggggagccccacaugaucgucagccggcaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacagcaccuccaccugggugaccuacgggaccugcaccaccaccggcgagcaccggcgcgagaagcggagcgucgcccuggugccccacgugggcauggggcucgagacccgcaccgagaccuggauguccagcgagggcgccuggaagcacgcccagcggaucgagaccuggauccugcgccaccccggguucaccaucauggccgcgauccuggccuacaccaucggcaccacgcacuuccagcgggcccucaucuucauccugcugaccgccgucgcgcccuccaugaccaugcgcugcaucgggaucagcaaccgggacuucguggagggcguguccggcgggagcugggucgacaucgugcucgagcacggcuccugcgugaccacgauggccaagaacaagcccacccuggacuucgagcugaucaagaccgaggccaagcagcccgccacccuccgcaaguacugcaucgaggccaagcugacgaacaccaccaccgagagccggugcccgacgcagggggagcccucccugaacgaggagcaggacaagcgcuucgucugcaagcacagcaugguggaccggggcuggggcaacgggugcggccucuucgggaagggcgggaucgugaccugcgcgauguucacgugcaagaagaacauggagggcaaggucgugcagcccgagaaccuggaguacaccaucgugaucacgccccacuccggcgaggagcacgccgucgggaacgacaccggcaagcacgggaaggagaucaagaucaccccgcagagcuccaucaccgaggccgagcugaccggcuacgggacggugaccauggagugcagcccccgcaccggccucgacuucaacgagauggugcugcugcagauggagaacaaggccuggcucguccaccggcagugguuccuggaccugccccuccccuggcugccgggcgccgacacccagggguccaacuggauccagaaggagacgcuggugaccuucaagaacccccacgcgaagaagcaggacguggucgugcucggcagccaggagggggccaugcacaccgcccugaccggcgccacggagauccagaugagcuccgggaaccuccuguucaccggccaccugaagugccgccugcggauggacaagcuccagcugaagggcaugagcuacuccaugugcaccgggaaguucaaggucgugaaggagaucgccgagacccagcacggcacgaucgugauccgcguccaguacgagggggacggcagccccugcaagauccccuucgagaucauggaccuggagaagcggcacgugcucggccgccugaucaccgugaacccgaucgucaccgagaaggacucccccgugaacaucgaggcggagccgcccuucggggacagcuacaucaucaucggcguggagccggggcagcugaagcucaacugguucaagaagggcuccagcaucgggcagauguucgagaccacgaugcgcggcgccaagcggauggccauccugggcgacaccgccugggacuucgggucccugggcggggucuucaccagcaucggcaaggcccuccaccagguguucggggcgaucuacggcgccgccuucuccggcgugagcuggaccaugaagauccugaucggggucaucaucacguggaucggcaugaacucccgcagcaccucccugagcgugucccuggugcucgucgggguggugacccuguaccugggcgucauggugcaggccgacagcgggugcguggucuccuggaagaacaaggagcucaagugcggcagcggcaucuucaucaccgacaacgugcacacguggaccgagcaguacaaguuccagcccgagagccccuccaagcuggcgagcgccauccagaaggcccacgaggaggggaucugcggcauccgguccgugacccgccuggagaaccucauguggaagcagaucacccccgagcugaaccacauccugagcgagaacgaggucaagcucacgaucaugaccggggacaucaagggcaucaugcaggccgggaagcggucccugcgcccgcagcccaccgagcugaaguacagcuggaagaccuggggcaaggccaagaugcucuccacggagagccacaaccagaccuuccugaucgacggccccgagaccgcggagugcccgaacaccaaccgggccuggaacucccuggagguggaggacuacggguucggcguguucacgaccaacaucuggcucaagcugcgcgagaagcaggacgucuucugcgacagcaagcugauguccgccgccaucaaggacaaccgggccgugcacgcggacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgccggccccgugagccagcacaacuaccgcccgggguaccacacccagacggccggccccuggcaccucgggaagcuggagauggacuucgacuucugcgagggcaccaccguggucgugaccgaggacugcgggaaccggggccccagccugcgcacgaccaccgcguccggcaagcucaucaccgaguggugcugccggagcugcacgcugcccccgcugcgcuaccgcggggaggacggcugcugguacgggauggagauccgcccccucaaggagaaggaggagaaccuggugaacucccuggucaccgccggccacgggcagaucgacaacuucagccucggcgugcugggcauggcccuguuccucgaggagaugcugcggacccgcguggggaccaagcacgccauccugcucgucgcgguguccuucgugacgcugaucaccggcaacaugagcuuccgggaccuggggcgcgucauggugauggugggcgccaccaugaccgacgacaucgggaugggcgucacguaccucgcccugcuggccgccuucaaggugcgccccaccuucgcggccggccuccugcugcggaagcucaccuccaaggagcugaugaugaccacgaucgggaucgugcugcucagccaguccaccauccccgagaccauccuggagcugaccgacgcccucgcccugggcaugaugguccugaagauggugcgcaagauggagaaguaccagcucgccgugacgaucauggcgauccugugcgucccgaacgccgugauccugcagaacgccuggaaggucagcugcaccauccucgccgugguguccgucagcccccugcugcucaccuccagccagcagaaggccgacuggaucccccuggcgcugaccaucaaggggcucaaccccacggccaucuuccugaccacccugucccggaccaacaagaagcgcagcuggccgcucaacgaggccaucauggccgugggcaugguguccauccuggcgagcucccugcucaagaacgacauccccaugacgggcccccuggucgccgggggccugcucaccgugugcuacgugcugaccgggcggagcgccgaccuggagcucgagcgcgccgccgacgucaagugggaggaccaggcggagaucagcggcuccagccccauccuguccaucaccaucagcgaggacggguccaugagcaucaagaacgaggaggaggagcagacgcugaccauccucauccggaccggccugcuggugaucuccggccucuucccggugagcauccccaucaccgccgccgccugguaccugugggaggucaagaagcagcgcgccggggugcugugggacgugcccagcccgccgcccgucggcaaggcggagcucgaggacggggccuaccggaucaagcagaagggcauccugggguacagccagaucggcgccggcguguacaaggaggggaccuuccacacgauguggcacgugacccgcggcgccguccugaugcacaaggggaagcggaucgagcccuccugggccgacgugaagaaggaccucaucagcuacggcgggggcuggaagcuggagggcgaguggaaggagggggaggaggugcagguccuggcgcucgagcccggcaagaacccccgcgccgugcagaccaagcccgggcuguucaagaccaacgccggcacgaucggggccgugucccuggacuucagccccggcaccuccggcagccccaucaucgacaagaaggggaaggucgugggccucuacgggaacggcguggucacccgguccggcgccuacgugagcgcgaucgcccagaccgagaaguccaucgaggacaaccccgagaucgaggacgacaucuuccgcaagcggaagcugacgaucauggaccugcaccccggggccggcaagaccaagcgcuaccugcccgccaucgugcgggaggcgaucaagcgcgggcuccggacccugauccuggccccgacccgcgucguggccgccgagauggaggaggcccuccggggccugcccauccgcuaccagacgcccgcgauccgcgccgagcacaccgggcgggagaucguggaccugaugugccacgccaccuucaccaugcgccuccugagccccguccgggugccgaacuacaaccugaucaucauggacgaggcccacuucacggaccccgccagcaucgcggcccgcggcuacaucuccacccggguggagaugggcgaggccgccgggaucuucaugaccgccacgccgcccggcagccgcgacccguucccccaguccaacgcgcccaucauggacgaggagcgggagauccccgagcgcagcugguccagcgggcacgagugggucacggacuucaagggcaagaccgugugguucgugccguccaucaaggccgggaacgacaucgccgccugccuccggaagaacggcaagaaggucauccagcugagccgcaagaccuucgacuccgaguacgugaagacccggacgaacgacugggacuucguggucaccaccgacaucagcgagaugggcgcgaacuucaaggccgagcgcgugaucgacccccggcgcugcaugaagcccgugauccugaccgacggggaggagcgggucauccucgccggccccaugccggugacgcacuccagcgccgcccagcgccgggggcgcaucggccggaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccgccugcgcggggaggcccgcaagaccuucgucgaccugaugcggcgcggcgaccuccccguguggcuggccuaccggguggcggccgaggggaucaacuacgccgaccgccgguggugcuucgacggcaucaagaacaaccagauccuggaggagaacgucgagguggagaucuggaccaaggagggggagcgcaagaagcucaagccgcgguggcuggacgcccgcaucuacagcgacccccuggcccucaaggaguucaaggaguucgcggccggccggaagucccugacgcugaaccucaucaccgagaugggccgccugcccaccuucaugacccagaaggcccgggacgcccuggacaaccucgcgguccugcacacggccgaggccgggggccgcgccuacaaccacgcccugagcgagcuccccgagacccuggagacccugcuccugcugacccuccuggcgacggugaccgggggcaucuuccuguuccucauguccggccgggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugacguacgucgugaucgcgauccucaccguggucgccgccaccauggccaacgagaugggcuuccuggagaagaccaagaaggaccuggggcucggcagcaucacgacccagcagccggagagcaacauccuggacaucgaccugcggcccgccuccgcguggacccucuacgccguggccaccacguucgugacccccaugcugcgccacagcaucgagaacuccagcgucaacgugucccugaccgccaucgccaaccaggcgaccgugcucaugggccuggggaagggcuggccccugagcaagauggacaucggggucccgcuccuggccaucggcugcuacucccaggugaaccccaucacgcugaccgccgcccuccugcugcucguggcgcacuacgccaucaucgggcccggccugcaggccaaggccacccgggaggcccagaagcgcgcggccgccggcaucaugaagaaccccaccgucgacgggaucacggugaucgaccuggacccgauccccuacgaccccaaguucgagaagcagcucggccaggugaugcugcugguccucugcgugacccaggugcugaugaugcggaccaccugggcccugugcgaggcccucacgcuggcgaccgggcccaucagcacccugugggagggcaacccggggcgcuucuggaacaccacgaucgccgucuccauggccaacaucuuccgcggcagcuaccucgccggcgccgggcugcuguucuccaucaugaagaacaccaccaacacccggcgcggcacggggaacaucggcgagacccucggcgagaaguggaagucccggcugaacgcgcuggggaaguccgaguuccagaucuacaagaaguccggcauccaggagguggaccgcacccucgccaaggaggggaucaagcggggcgagaccgaccaccacgccgugucccgcgggagcgccaagcugcggugguucgucgagcgcaacauggugacgcccgagggcaagguggucgaccugggcugcgggcggggcgggugguccuacuacugcggcgggcucaagaacgugcgcgaggugaagggccugaccaagggcgggcccggccacgaggagcccaucccgaugagcaccuacggguggaaccugguccggcuccaguccggcguggacguguucuucacgccgcccgagaagugcgacacgcugcugugcgacaucggggagagcagccccaacccgaccgucgaggcgggccgcacccuccgggugcugaaccugguggagaacuggcucaacaacaacacccaguucugcaucaagguccugaaccccuacaugcccuccgugaucgagaagauggaggcccugcagcgcaaguacggcggggcccuggugcggaacccgcucagccgcaacuccacccacgagauguacugggucagcaacgccuccggcaacaucgugagcuccgugaacaugaucagccggaugcugaucaaccgcuucacgaugcggcacaagaaggccaccuacgagcccgacgucgaccugggguccggcacccgcaacaucgggaucgagagcgagauccccaaccucgacaucaucggcaagcgcaucgagaagaucaagcaggagcacgagaccuccuggcacuacgaccaggaccaccccuacaagacgugggcguaccacggcagcuacgagaccaagcagaccggguccgccagcuccauggugaacggcgugguccggcugcugaccaagccgugggacguggugcccauggucacgcagauggccaugaccgacaccacccccuucgggcagcagcgcguguucaaggagaagguggacacgcggacccaggagcccaaggagggcaccaagaagcucaugaagaucaccgccgaguggcuguggaaggagcugggcaagaagaagacgccgcgcaugugcacccgggaggaguucacccgcaagguccggagcaacgccgcgcucggggccaucuucaccgacgagaacaaguggaaguccgcccgcgaggccguggaggacagccgguucugggagcuggucgacaaggagcgcaaccugcaccucgagggcaagugcgagacgugcguguacaacaugauggggaagcgggagaagaagcugggcgaguucgggaaggccaagggcucccgcgcgaucugguacauguggcugggcgcccgguuccucgaguucgaggcccugggguuccugaacgaggaccacugguucagccgcgagaacagccucuccggcguggagggggagggccugcacaagcugggguacauccuccgggacgucagcaagaaggagggcggcgccauguacgcggacgacaccgccgggugggacacccgcaucacccuggaggaccugaagaacgaggagauggugacgaaccacauggagggcgagcacaagaagcucgccgaggccaucuucaagcugaccuaccagaacaaggugguccgggugcagcgccccacgccccgggggaccgugauggacaucaucucccgccgggaccagcgcggcagcgggcaggucggcacguacggccugaacaccuucaccaacauggaggcccagcucauccgccagauggagggggagggcguguucaaguccauccagcaccugaccgugacggaggagaucgcgguccagaacuggcuggcccggguggggcgcgagcggcucagccgcauggccaucuccggcgacgacugcguggucaagccccuggacgaccgguucgccagcgcccugaccgcgcucaacgacaugggcaaggugcgcaaggacauccagcagugggagccgucccggggguggaacgacuggacccaggugcccuucugcagccaccacuuccacgagcugaucaugaaggacggccgcguccugguggugcccugccggaaccaggacgagcucaucgggcgcgcccggaucucccagggcgccggguggagccugcgcgagaccgccugccugggcaaguccuacgcccagauguggagccucauguacuuccaccggcgcgaccugcggcuggcggccaacgccaucugcuccgccguccccagccacugggugccgacgucccgcaccaccuggagcauccacgccaagcacgaguggaugaccaccgaggacaugcucacgguguggaaccgggucuggauccaggagaaccccuggauggaggacaagacccccguggagagcugggaggagauccccuaccugggcaagcgcgaggaccaguggugcgggucccugaucggccucaccagccgggcgaccugggccaagaacauccagacggccaucaaccaggugcgcucccugaucgggaacgaggaguacaccgacuacaugccgagcaugaagcgcuuccggcgcgaggaggaggaggccggcguccugugguga

SEQ ID NO: 9740 - RNA, 9876 nt, Artificial Sequence
  derived and/or modified CDS sequence (opt1) from DENV-2__GQ398263__SS-prME
accgccgggaugaucaucaugaugauccccaccgugauggccuuccaccugaccacccggaacggggagccccacaugaucgucagccggcaggagaagggcaagagccuccuguucaagaccgaggacggggugaacaugugcacccugauggcgauggaccucggggagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaagaucaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucguggugcgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgugauggugcaggcggacuccgggugcgucgugagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgucacccgccuggagaaccugauguggaagcagaucacccccgagcucaaccacauccuguccgagaacgaggugaagcugaccaucaugacgggggacaucaagggcaucaugcaggccgggaagcggagccuccgcccgcagcccaccgagcugaaguacuccuggaagaccuggggcaaggcgaagaugcugagcaccgagcuccacaaccacacguuccugaucgacggccccgagaccgccgagugcccgaccaccaaccgggccuggaacucccuggagguggaggacuacggguucggcgucuucacgaccaacaucuggcucaagcugaaggagcgccaggacgugcugugcgacagcaagcucauguccgccgccaucaaggacaaccgggcggugcacgccgacaugggguacuggaucgagagcgcccugaacgacaccuggaagaucgagaaggccuccuucaucgaggucaagagcugccacuggcccaagucccacacccuguggagcaacggcgugcucgaguccgagaugaucauccccaagaacuucgccggccccgugagccagcacaacuaccgcccgggguaccacacccagacggcgggccccuggcaccuggggaagcuggagauggacuucgacuucugcgagggcaccaccgucguggugaccgaggacugcgggaaccggggccccagccuccgcacgaccaccgccuccggcaagcugaucaccgaguggugcugccggagcugcacgcugcccccgcuccgcuaccgcggggaggacggcugcugguacgggauggagauccgcccccugaaggacaaggaggagaaccuggucaacucccucgugaccgccggccacgggcagaucgacaacuucagccugggcgugcugggcauggcccucuuccuggaggagaugcugcggacccgcgucgggaccaagcacgcgauccuccugguggccguguccuucgucacgcugaucaccggcaacaugagcuuccgggaccucgggcgcgugauggugauggucggcgccaccaugaccgacgacaucgggaugggcgugacguaccuggcccugcucgccgcguucaaggugcgccccaccuucgccgccggccugcugcuccggaagcugaccuccaaggagcugaugaugaccacgaucgggaucguccuccugagccaguccaccauccccgagaccauccuggagcucaccgacgcccuggcccugggcaugauggugcucaagaucguccgcaacauggagaaguaccagcuggcggugacgaucauggccauccugugcgugccgaacgccgucauccuccagaacgccuggaaggugagcugcaccauccuggccguggucuccgugagcccccugcuccugaccuccagccagcagaaggcggacuggaucccccuggcccucaccaucaaggggcugaaccccacggccaucuuccugaccacccucucccggaccagcaagaagcgcuccuggccgcugaacgaggccaucauggcggugggcauggucagcauccuggccuccagccuccugaagaacgacauccccaugacgggcccccugguggccgggggccuccugaccgugugcuacguccugaccgggcggagcgccgaccucgagcuggagcgcgccgcggacgugcggugggaggaccaggccgagaucuccggcagcucccccauccugagcaucaccaucuccgaggacgggagcauguccaucaagaacgaggaggaggagcagacgcucaccauccugauccgcaccggccugcucgugaucagcggccuguucccggucuccauccccaucaccgccgccgccugguaccugugggaggugaagaagcagcgggcgggggugcucugggacguccccagcccgccgcccgugggcaaggccgagcuggaggacggggccuaccgcaucaagcagaagggcauccugggguacucccagaucggcgccggcguguacaaggaggggaccuuccacacgauguggcacgucacccggggcgccgugcucaugcacaaggggaagcgcaucgagcccagcugggcggacgugcggaaggaccugaucuccuacggcgggggcuggaagcuggagggcgaguggaaggagggggaggagguccaggugcucgcccuggagcccggcaagaacccccgcgccgugcagaccaagcccgggcuguucaagaccaacacgggcaccaucggggccgucagccucgacuucucccccggcaccagcggcucccccaucguggacaagaaggggaagguggucggccuguacgggaacggcguggugacccggagcggcacguacgucuccgccaucgcgcagaccgagaaguccaucgaggacaaccccgagaucgaggacgacaucuuccgcaagaagcggcugaccaucauggaccugcaccccggggccggcaagaccaagcgcuaccuccccgccaucgugcgggaggccaucaagcgcgggcugcggacgcugauccucgcgccgacccgcguggucgccgccgagauggaggaggcccugcgcggccugcccauccgguaccagacccccgccauccgcgcggagcacaccgggcgggagaucguggaccucaugugccacgccacguucaccaugcgccugcugagccccgugcgggucccgaacuacaaccucaucaucauggacgaggcccacuucaccgaccccgccuccaucgccgcgcgcggcuacaucagcacccggguggagaugggcgaggccgccgggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggcggggaacgacaucgccgccugccugcggaagaacggcaagaaggugauccagcugagccgcaagacguucgacuccgaguacaucaagacccggaccaacgacugggacuucgucgugaccacggacaucagcgagaugggcgccaacuucaaggcggagcgcgugaucgacccccggcgcugcaugaagcccgucauccucaccgacggggaggagcgggugauccuggccggccccaugccggugacccacuccagcgccgcccagcgccgggggcgcaucggccgcaaccccaagaacgagaacgaccaguacaucuacaugggggagccccuggagaacgacgaggacugcgcccacuggaaggaggcgaagaugcuccuggacaacaucaacacccccgagggcaucaucccguccauguucgagcccgagcgggagaaggucgacgccaucgacggcgaguaccgccugcgcggggaggcccgcaagacguucguggaccucaugcggcgcggcgaccugcccgucuggcuggccuaccggguggccgcggaggggaucaacuacgccgaccgccgguggugcuucgacggcaucaagaacaaccagauccucgaggagaacguggaggucgagaucuggaccaaggagggggagcgcaagaagcugaagccgcgguggcuggacgcccgcaucuacagcgacccccucgcccugaaggaguucaaggaguucgccgcgggccggaagucccugacccucaaccugaucaccgagaugggccgccugcccacguucaugacccagaaggcccggaacgcccucgacaaccuggccgugcugcacaccgcggaggccgggggccgcgccuacaaccacgcccucagcgagcugcccgagacccuggagacgcuccugcugcucacccugcuggccaccgugaccgggggcaucuuccucuuccugauguccggcaaggggaucggcaagaugacccuggggaugugcugcaucaucacggcgagcauccuccugugguacgcccagauccagccgcacuggaucgccgccuccaucauccuggaguucuuccucaucguccugcugauccccgagcccgagaagcagcggacgccccaggacaaccagcucaccuacguggugaucgccauccugaccgucguggcggccacgauggccaacgagaugggcuuccuggagaagaccaagaaggacuucgggcucggcagcaucgccacccagcagccggagagcaacauccuggacaucgaccugcgccccgccuccgcguggacccucuacgccguggccacgaccuucaucacccccaugcugcggcacagcaucgagaacuccagcgucaacgugucccugaccgccaucgccaaccaggcgacggugcucaugggccuggggaagggcuggccccugagcaagauggacaucggggucccgcuccuggccaucggcugcuacucccaggugaaccccaucacccugaccgccgcccuccugcugcucguggcgcacuacgccaucaucgggcccggccugcaggccaaggccacccgcgaggcccagaagcgggcggccgccggcaucaugaagaaccccacggucgacgggaucaccgugaucgaccuggacccgauccccuacgaccccaaguucgagaagcagcucggccaggugaugcugcugguccucugcgugacccaggugcugaugaugcgcaccacgugggcccugugcgaggcccucacccuggcgaccgggcccaucagcacccugugggagggcaacccggggcgcuucuggaacacgaccaucgccgucuccauggccaacaucuuccggggcagcuaccucgccggcgccgggcugcuguucuccaucaugaagaacaccgcgaacacccgccggggcacggggaacaccggcgagacccucggcgagaaguggaagaaccgccugaacgcccugggcaagagcgaguuccagaucuacaagaaguccggcauccaggagguggaccggacccucgccaaggaggggaucaagcgcggcgagacggaccaccacgccgugagccggggguccgcgaagcugcgcugguucgucgagcggaaccuggugacccccgagggcaagguggucgaccucggcugcgggcgcggcggguggagcuacuacugcggcgggcugaagaacgugaaggaggugaagggccugaccaagggcgggcccggccacgaggagcccaucccgauguccaccuacggguggaaccucguccggcugcagagcggcguggacguguucuucacgccgcccgagaagugcgacacccugcucugcgacaucggggaguccagccccaacccgaccgucgaggccggccgcacccugcgggugcugaaccucguggagaacuggcugaacaacaacacccaguucugcaucaagguccugaaccccuacaugcccagcgugaucgagaagauggaggcccugcagcgcaaguacggcggggcccucgugcggaacccgcugucccgcaacagcacgcacgagauguacugggucuccaacgccagcggcaacaucguguccagcgugaacaugaucucccggaugcugaucaaccgcuucaccaugcggcacaagaaggcgaccuacgagcccgacgucgaccucgggagcggcacccgcaacaucgggaucgaguccgagauccccaaccuggacgugaucggcaagcgcaucgagaagaucaagcaggagcacgagacgagcuggcacuacgaccaggaccaccccuacaagaccugggccuaccacggcuccuacgagaccaagcagaccgggagcgccuccagcauggugaacggcgucgugcggcugcucacgaagccgugggacgugauccccauggucacccagauggccaugaccgacaccacgcccuucgggcagcagcgcguguucaaggagaaggucgacacccggacccaggagcccaaggagggcaccaagaagcugaugaagaucacggccgaguggcuguggaaggagcucggcaagaagaagaccccgcgcaugugcacccgggaggaguucacccgcaaggugcgguccaacgcggcccugggggccaucuacacggacgagaacaaguggaaguccgcccgcgaggccguggaggacucccgguucugggagcuggucgacaaggagcgcaaccuccaccuggagggcaagugcgagaccugcguguacaacaugauggggaagcgggagaagaagcugggcgaguucgggaaggcgaagggcagccgcgccaucugguacauguggcucggcgcccgguuccuggaguucgaggcccugggguuccucaacgaggaccacugguucucccgcgagaacagccugagcggcguggagggggagggccugcacaagcucggguacauccugcgggacgucuccaagaaggagggcggcgcgauguacgccgacgacaccgccgggugggacacccgcaucacgcuggaggaccucaagaacgaggagauggugaccaaccacauggagggcgagcacaagaagcuggccgaggccaucuucaagcugaccuaccagaacaaggugguccgggugcagcgccccacgccccgggggacggugauggacaucaucagccgccgggaccagcgcggcuccgggcaggucgugaccuacggccucaacaccuucaccaacauggaggcgcagcugauccgccagauggagggcgaggggguguucaagagcauccagcaccugacggucaccgaggagaucgccgugaagaacuggcucgcccgggugggccgcgagcggcugucccgcauggccaucagcggggacgacugcgucgugaagccccuggacgaccgguucgccuccgcgcucaccgcccugaacgacaugggcaaggugcgcaaggacauccagcagugggagccgagccggggcuggaacgacuggacccagguccccuucugcucccaccacuuccacgagcugaucaugaaggacgggcgcgugcucgugguccccugccggaaccaggacgagcugaucggccgcgcccggaucagccagggggccggcuggucccugcgcgagacggccugccucggcaagagcuacgcgcagauguggucccugauguacuuccaccggcgcgaccugcggcucgccgccaacgccaucugcagcgccgugcccucccacugggugccgaccagccgcaccaccugguccauccacgcgacccacgaguggaugacgaccgaggacaugcugaccgucuggaaccggguguggauccaggagaaccccuggauggaggacaagacccccguggagagcugggaggagauccccuaccugggcaagcgcgaggaccaguggugcggcagccucaucgggcugacgucccgggccaccugggccaagaacauccagaccgccaucaaccagguccgcagccugaucggcaacgaggaguacaccgacuacaugccguccaugaagcgcuuccggcgcgaggaggaggaggcgggggugcucugguga

SEQ ID NO: 9741 - RNA, 9876 nt, Artificial Sequence
  derived and/or modified CDS sequence (opt1) from DENV-2__GQ398264__SS-prME
accgccgggaugaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccaccuacuuccagcgggugcugaucuucauccuccugaccgccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaagaucaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaagaccuggggcaaggcgaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuucugcgacagcaagcugauguccgccgccaucaaggacaaccgggcggugcacgccgacaugggguacuggaucgagagcgcccucaacgacaccuggaugaucgagaaggccuccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgcgggccccuggcagcucgggaagcuggagauggacuucgacuucugcgagggcacgaccguggucgugaccgaggacugcgggaaccggggccccagccugcgcaccacgaccgccuccggcaagcucaucaccgaguggugcugccggagcugcacccugcccccgcugcgcuaccgcggggaggacggcugcugguacgggauggagauccgcccccucaaggagaaggaggagaaccuggugaacucccuggucacggccggccacgggcagaucgacaacuucagccucggcgugcugggcauggcccuguuccucgaggagaugcugcggacccgcguggggaccaagcacgcgauccugcucgucgccguguccuucgugacccugaucacgggcaacaugagcuuccgggaccuggggcgcgucauggugauggugggcgccaccaugaccgacgacaucgggaugggcgucaccuaccucgcccugcuggccgcguucaaggugcgccccacguucgccgccggccuccugcugcggaagcucaccuccaaggagcugaugaugaccaccaucgggaucgugcugcucagccaguccacgauccccgagaccauccuggagcugaccgacgcccucgcccugggcaugaugguccugaagaucgugcgcaacauggagaaguaccagcucgcggucaccaucauggccauccugugcgugccgaacgccgugauccugcagaacgccuggaaggucagcugcacgacccucgccgugguguccgucagcccccugcugcucaccuccagccagcagaaggcggacuggaucccccuggcccugaccaucaaggggcucaaccccacggccaucuuccugaccacccugucccggaccagcaagaagcgcuccuggccgcucaacgaggccaucauggcggugggcauggugagcauccuggccuccagccugcucaagaacgacauccccaugacgggcccccuggucgccgggggccugcucaccgugugcuacgugcugaccgggcggagcgccgaccuggagcucgagcgcgccgcggacguccggugggaggaccaggccgagaucuccggcagcucccccauccugagcaucaccaucuccgaggacgggagcauguccaucaagaacgaggaggaggagcagacgcugaccauccucauccgcaccggccugcuggugaucagcggccucuucccgguguccauccccaucaccgccgccgccugguaccugugggaggucaagaagcagcgggcgggggugcugugggacgugcccagcccgccgcccgucggcaaggccgagcucgaggacggggccuaccgcaucaagcagaagggcauccugggguacucccagaucggcgccggcguguacaaggaggggaccuuccacacgauguggcacgugacccggggcgccguccugaugcacaaggggaagcgcaucgagcccagcugggcggacgugcggaaggaccucaucuccuacggcgggggcuggaagcuggagggcgaguggaaggagggggaggaggugcagguccuggcccucgagcccggcaagaacccccgcgccgugcagaccaagcccgggcuguucaagaccaacacgggcaccaucggggccgugagccuggacuucucccccggcaccagcggcucccccaucgucgacaagaaggggaagguggugggccucuacgggaacggcgucgugacccggagcggcacguacguguccgccaucgcgcagaccgagaaguccaucgaggacaaccccgagaucgaggacgacaucuuccgcaagaagcggcugaccaucauggaccugcaccccggggccggcaagaccaagcgcuaccugcccgccaucguccgggaggccaucaagcgcgggcuccggacgcugauccuggcgccgacccgcgugguggccgccgagauggaggaggcccuccgcggccugcccauccgguaccagacccccgccauccgcgcggagcacaccgggcgggagaucgucgaccugaugugccacgccacguucaccaugcgccuccugagccccgugcgggugccgaacuacaaccugaucaucauggacgaggcccacuucaccgaccccgccuccaucgccgcgcgcggcuacaucagcacccgggucgagaugggcgaggccgccgggaucuucaugacggccacgccgcccggcucccgcgacccguucccccagagcaacgcccccaucauggacgaggagcgggagauccccgagcgcuccuggaacagcgggcacgagugggugaccgacuucaagggcaagaccgugugguucgucccguccaucaaggcggggaacgacaucgccgccugccuccggaagaacggcaagaaggugauccagcugagccgcaagacguucgacuccgaguacaucaagacccggaccaacgacugggacuucguggucaccacggacaucagcgagaugggcgccaacuucaaggcggagcgcgugaucgacccccggcgcugcaugaagcccgugauccugaccgacggggaggagcgggucauccucgccggccccaugccggugacccacuccagcgccgcccagcgccgggggcgcgugggccgcaaccccaagaacgagaacgaccaguacaucuacaugggggagccccuggagaacgacgaggacugcgcccacuggaaggaggcgaagaugcugcucgacaacaucaacacccccgagggcaucaucccguccauguucgagcccgagcgggagaaggucgacgccaucgacggcgaguaccgccugcgcggggaggcccgcaagacguucguggaccugaugcggcgcggcgaccuccccgucuggcuggccuaccggguggccgcggaggggaucaacuacgccgaccgccgguggugcuucgacggcgugaagaacaaccagauccuggaggagaacgucgagguggagaucuggaccaaggagggggagcgcaagaagcucaagccgcgguggcuggacgcccgcaucuacagcgacccccuggcccucaaggaguucaaggaguucgccgcgggccggaagucccugacccugaaccucaucaccgagaugggccgccugcccacguucaugacccagaaggcccggaacgcccuggacaaccucgccgugcugcacaccgcggaggccgggggccgcgccuacaaccacgcccugagcgagcuccccgagacccuggagacgcugcuccugcugacccuccuggccaccgucaccgggggcaucuuccuguuccucauguccggcaaggggaucggcaagaugacccuggggaugugcugcaucaucacggcgagcauccugcucugguacgcccagauccagccgcacuggaucgccgccuccaucauccuggaguucuuccugaucgugcuccugauccccgagcccgagaagcagcggacgccccaggacaaccagcugaccuacguggucaucgccauccucaccgugguggcggccacgauggccaacgagaugggcuuccuggagaagaccaagaaggacuucgggcugggcagcaccgccacccagcagccggagagcaacauccucgacaucgaccugcgccccgccuccgcguggacgcuguacgccgucgccaccaccuucaucacccccaugcuccggcacagcaucgagaacuccagcgugaacgugucccugacggccaucgccaaccaggcgaccguccugaugggccucgggaagggcuggccccugagcaagauggacaucggggugccgcugcucgccaucggcugcuacucccaggugaaccccaucacccugaccgccgcccugcuccugcuggucgcgcacuacgccaucaucgggcccggccuccaggccaaggccacgcgcgaggcccagaagcgggcggccgccggcaucaugaagaaccccaccguggacgggaucaccgugaucgaccuggacccgauccccuacgaccccaaguucgagaagcagcugggccaggucaugcuccuggugcugugcgugacccagguccucaugaugcgcacgaccugggcccugugcgaggcccugacccucgcgaccgggcccaucagcacgcugugggagggcaacccggggcgcuucuggaacaccaccaucgccguguccauggccaacaucuuccggggcagcuaccuggccggcgccgggcuccuguucuccaucaugaagaacaccgcgaacacgcgccggggcaccgggaacaccggcgagacccugggcgagaaguggaagaaccgccucaacgcccugggcaagagcgaguuccagaucuacaagaaguccggcauccaggagguggaccggacgcuggccaaggaggggaucaagcgcggcgagaccgaccaccacgccgucagccggggguccgcgaagcuccgcugguucguggagcggaaccuggugacccccgagggcaaggucguggaccugggcugcgggcgcggcggguggagcuacuacugcggcgggcucaagaacgugaaggaggucaagggccugaccaagggcgggcccggccacgaggagcccaucccgauguccacguacggguggaaccuggugcggcuccagagcggcguggacgucuucuucacgccgcccgagaagugcgacacccugcugugcgacaucggggaguccagccccaacccgaccguggaggccggccgcacccuccgggugcugaaccuggucgagaacuggcucaacaacaacacgcaguucugcaucaaggugcugaaccccuacaugcccagcgugaucgagaagauggaggcccugcagcgcaaguacggcggggcccugguccggaacccgcucucccgcaacagcacccacgagauguacuggguguccaacgccagcggcaacaucguguccagcgucaacaugaucucccggaugcugaucaaccgcuucaccaugcggcacaagaaggcgaccuacgagcccgacguggaccuggggagcggcacgcgcaacaucgggaucgaguccgagacccccaaccucgacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggugaacggcgucgugcggcugcugaccaagccgugggacgugauccccauggucacccagauggccaugacggacaccacccccuucgggcagcagcgcguguucaaggagaaggucgacacccggacgcaggagcccaaggagggcaccaagaagcucaugaagaucaccgccgaguggcuguggaaggagcugggcaagaagaagaccccgcgcaugugcacgcgggaggaguucacccgcaaggugcgguccaacgcggcccucggggccaucuucaccgacgagaacaaguggaaguccgcccgcgaggccguggaggacuccggcuucugggagcuggucgacaaggagcggaaccugcaccucgaggggaagugcgagaccugcguguacaacaugaugggcaagcgcgagaagaagcugggggaguucggcaaggcgaagggcagccgggccaucugguacauguggcugggggcccgcuuccucgaguucgaggcccugggcuuccugaacgaggaccacugguucucccgggagaacagccucagcgggguggagggcgaggggcugcacaagcugggcuacauccuccgcgacgucuccaagaaggagggcggggcgauguacgccgacgacacggccggcugggacacccggaucacccuggaggaccugaagaacgaggagauggugaccaaccacauggagggggagcacaagaagcucgccgaggccaucuucaagcugacguaccagaacaaggugguccgcgugcagcggcccacgccccggggcaccgugauggacaucaucagccggcgcgaccagcggggguccggccaggucgugaccuacggccugaacacguucaccaacauggaggcgcagcucauccgccagauggagggggagggcguguucaagagcauccagcaccugaccgucaccgaggagaucgccgugaagaacuggcuggcccgcguggggcgggagcgccucucccggauggccaucagcggcgacgacugcgucgugaagccccuggacgaccgcuucgccuccgcgcugacggcccucaacgacaugggcaaggugcggaaggacauccagcagugggagccgagccgcggguggaacgacuggacccagguccccuucugcucccaccacuuccacgagcugaucaugaaggacggccgggugcuggugguccccugccgcaaccaggacgagcucaucgggcgggcccgcaucagccagggcgccggguggucccugcgggagaccgccugccugggcaagagcuacgcgcagauguggucccucauguacuuccaccgccgggaccugcgccuggccgccaacgccaucugcagcgccgugcccucccacugggugccgaccagccggaccacgugguccauccacgcgacccacgaguggaugaccaccgaggacaugcucacggucuggaaccgcguguggauccaggagaaccccuggauggaggacaagacccccguggagagcugggaggagauccccuaccugggcaagcgggaggaccaguggugcgggagccugaucggccucaccucccgcgccaccugggccaagaacauccagacggccaucaaccagguccggagccugaucgggaacgaggaguacaccgacuacaugccguccaugaagcgcuuccgccgggaggaggaggaggcgggcgugcugugguga

SEQ ID NO: 9742 - RNA, 9876 nt, Artificial Sequence
  derived and/or modified CDS sequence (opt1) from DENV-2__GQ398260__SS-prME
accgccggcaugaucaucaugcugauccccaccgugauggccuuccaccucaccacccggaacggggagccccacaugaucgucucccggcaggagaagggcaagucccugcuguucaagaccgaggacggggugaacaugugcacccucauggcgauggaccugggcgagcugugcgaggacaccaucaccuacaacugcccccuccugcgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcucgagacccgcaccgagaccuggauguccagcgagggcgccuggaagcacgcccagcggaucgagaccuggauccugcgccaccccggguucaccaucauggcggccauccuggccuacaccaucggcaccaccuacuuccagcggguccucaucuucauccugcugacggccguggcgcccuccaugaccaugcgcugcaucgggaucagcaaccgggacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccgcaaguacugcaucgaggccaagcugaccaacacgaccaccgcgagccggugcccgacccagggggagcccucccugaacgaggagcaggacaagcgcuucgugugcaagcacagcaugguggaccggggcuggggcaacgggugcggccucuucgggaagggcgggaucgucacgugcgccauguucacgugcaagaagaacauggagggcaagguggugcagcccgagaaccuggaguacaccaucgucaucacgccccacuccggcgaggagaacgccguggggaacgacacgggcaagcacgggaaggagaucaagaucaccccgcagagcuccaucaccgaggccgagcugaucggcuacgggaccgugaccauggagugcagcccccgcacgggccucgacuucaacgagaugguccugcugcagauggagaacaaggccuggcucgugcaccggcagugguuccuggaccugccccuccccuggcugccgggcgcggacacccagggguccaacuggauccagaaggagacccuggugaccuucaagaacccccacgccaagaagcaggacgucgugguccucggcagccaggagggggccaugcacacggcccugaccggcgccaccgagauccagaugagcuccgggaaccuccuguucaccggccaccugaagugccgccugcggauggacaagcuccagcugaagggcaugagcuacuccaugugcacggggaaguucaagguggugaaggagaucgcggagacccagcacggcaccaucgucauccgcgugcaguacgagggggacggcagccccugcaagauccccuucgagaucauggaccuggagaagcggcacgugcucggccgccugaucaccgucaacccgaucgugacggagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgccaagcggauggccauccugggcgacaccgccugggacuucgggucccugggcgggguguucacgagcaucggcaaggcgcuccaccagguguucggggccaucuacggcgccgccuucuccggcgucagcuggaccaugaagauccugaucgggguggugaucaccuggaucggcaugaacucccgcagcaccucccugagcgucucccuggugcucgugggggucgugacgcuguaccugggcgugaugguccaggcggacagcgggugcgugguguccuggaagaacaaggagcucaagugcggcagcggcaucuucgucaccgacaacgugcacaccuggaccgagcaguacaaguuccagcccgagagccccuccaagcuggccagcgccauccagaaggcccacgaggaggggaucugcggcauccgguccgugacgcgccuggagaaccucauguggaagcagaucacccccgagcugaaccacauccugagcgagaacgaggucaagcucaccaucaugaccggggacaucaagggcaucaugcaggccgggaagcggucccugcgcccgcagcccacggagcugaaguacagcuggaagaccuggggcaaggcgaagaugcucuccaccgagcugcacaaccagaccuuccugaucgacggccccgagacggccgagugcccgaacaccaaccgggccuggaacagccucgagguggaggacuacggguucggcguguucaccaccaacaucuggcugaagcugaaggagcgccaggacgucuucugcgacuccaagcucaugagcgccgccaucaaggacaaccgggcggugcacgccgacaugggguacuggaucgaguccgcccugaacgacacguggaagaucgagaaggccagcuucaucgaggugaaguccugccacuggcccaagagccacacccugugguccaacggcguccucgagagcgagaugaucauccccaagaacuucgccggccccgugucccagcacaacuaccgcccgggguaccacacccagaccgcgggccccuggcaccuggggaagcuggagauggacuucaacuucugcgagggcaccacgguggucgugaccgaggacugcgggaaccggggccccagccuccgcaccaccacggccagcggcaagcugaucaccgaguggugcugccgguccugcacccugcccccgcuccgcuaccgcggggaggacggcugcugguacgggauggagauccgcccccugaaggagaaggaggagaaccuggugaacagccucgucaccgccggccacgggcagaucgacaacuucucccugggcgugcugggcauggcccucuuccuggaggagaugcugcggacgcgcguggggaccaagcacgcgauccuccuggucgccgugagcuucgugacccugaucaccggcaacauguccuuccgggaccucgggcgcgucauggugauggugggcgccacgaugaccgacgacaucgggaugggcgucaccuaccuggcccugcucgccgcguucaaggugcgccccaccuucgccgccggccugcugcuccggaagcugacgagcaaggagcugaugaugaccaccaucgggaucgugcuccugucccagagcaccauccccgagacgauccuggagcucaccgacgcccuggcccugggcaugaugguccucaagaucgugcgcaacauggagaaguaccagcuggcggucaccaucauggccauccugugcgugccgaacgccgugauccuccagaacgccuggaaggucuccugcaccauccuggccguggugagcgucagcccccugcuccugacgagcucccagcagaaggcggacuggaucccccuggcccucaccaucaaggggcugaaccccaccgccaucuuccugaccacgcucagccggaccuccaagaagcgcagcuggccgcugaacgaggccaucauggcggugggcaugguguccauccuggccagcucccuccugaagaacgacauccccaugaccggcccccuggucgccgggggccuccugaccgugugcuacgugcugacggggcggagcgccgaccucgagcuggagcgcgccgcggacguccggugggaggaccaggccgagaucagcggcuccagccccauccuguccaucaccaucagcgaggacggguccaugagcaucaagaacgaggaggaggagcagacccucaccauccugauccgcacgggccugcucgugaucuccggccuguucccggugagcauccccaucaccgccgccgccugguaccugugggaggucaagaagcagcgggcgggggugcucugggacgugcccagcccgccgcccgucggcaaggccgagcuggaggacggggccuaccgcaucaagcagaagggcauccugggguacagccagaucggcgccggcguguacaaggaggggaccuuccacaccauguggcacgugacccggggcgccguccucaugcacaaggggaagcgcaucgagcccuccugggcggacgugaagaaggaccugaucagcuacggcgggggcuggaagcuggagggcgaguggaaggagggggaggaggugcagguccucgcccuggagcccggcaagaacccccgggccgugcagacgaagcccgggcuguucaagaccaacaccggcaccaucggggccgugucccucgacuucagccccggcacguccggcagccccaucgucgacaagaaggggaagguggugggccuguacgggaacggcgucgugacccgcuccggcaccuacgugagcgccaucgcgcagaccgagaaguccaucgaggacaaccccgagaucgaggacgacaucuuccggaagaagcgccugacgaucauggaccugcaccccggggccggcaagaccaagcgguaccuccccgccaucguccgcgaggccaucaagcgggggcugcgcacccugauccucgcgccgacccgggugguggccgccgagauggaggaggcccugcgcggccugcccauccgcuaccagacgcccgccauccgggcggagcacaccgggcgcgagaucgucgaccucaugugccacgccaccuucaccaugcggcugcugagccccgugcgcgugccgaacuacaaccucaucaucauggacgaggcccacuucacggaccccgccagcaucgccgcgcggggcuacaucuccacccgcgucgagaugggcgaggccgccgggaucuucaugaccgccacgccgcccggcagccgggacccguucccccaguccaacgcccccaucauggacgaggagcgcgagauccccgagcggagcuggaacuccgggcacgagugggugacggacuucaagggcaagaccgugugguucgucccgagcaucaaggcggggaacgacaucgccgccugccugcgcaagaacggcaagaaggugauccagcugucccggaagaccuucgacagcgaguacaucaagacccgcacgaacgacugggacuucguggucaccaccgacaucuccgagaugggcgccaacuucaaggcggagcgggugaucgacccccgccggugcaugaagcccgugauccucaccgacggggaggagcgcgucauccuggccggccccaugccggugacgcacagcuccgccgcccagcggcgcgggcggaucggccgcaaccccaagaacgagaacgaccaguacaucuacaugggggagccccuggagaacgacgaggacugcgcccacuggaaggaggcgaagaugcuccuggacaacaucaacacccccgagggcaucaucccgagcauguucgagcccgagcgcgagaagguggacgccaucgacggcgaguaccggcugcgcggggaggcccggaagaccuucgucgaccucaugcgccggggcgaccugcccguguggcuggccuaccgcgucgccgcggaggggaucaacuacgccgaccggcgcuggugcuucgacggcaucaagaacaaccagauccucgaggagaacguggagguggagaucuggaccaaggagggggagcggaagaagcugaagccgcgcuggcuggacgcccggaucuacuccgacccccucgcccugaaggaguucaaggaguucgccgcgggccgcaagagccugacgcucaaccugaucaccgagaucggccggcugcccaccuucaugacccagaaggcccgcaacgcccucgacaaccuggccguccugcacacggcggaggccgggggccgggccuacaaccacgcccucuccgagcugcccgagacccuggagacccuccugcugcucacccugcuggccacggugaccgggggcaucuuccucuuccugaugagcggcaaggggaucggcaagaugacccuggggaugugcugcaucaucaccgcguccauccuccugugguacgcccagauccagccgcacuggaucgccgccagcaucauccuggaguucuuccucaucgugcugcugauccccgagcccgagaagcagcgcacgccccaggacaaccagcucacguacgucgugaucgccauccugaccguggucgcggccaccauggccaacgagaugggcuuccuggagaagaccaagaaggacuucgggcucggcuccaucgccacgcagcagccggagagcaacauccuggacaucgaccugcggcccgccagcgcguggacccucuacgccguggccaccaccuucaucacgcccaugcugcgccacuccaucgagaacagcuccgugaacgucagccugaccgccaucgccaaccaggcgaccgugcucaugggccuggggaagggcuggccccuguccaagauggacaucggggugccgcuccuggccaucggcugcuacagccaggucaaccccaucacccugacggccgcccuccugcugcucguggcgcacuacgccaucaucgggcccggccugcaggccaaggccacccgggaggcccagaagcgcgcggccgccggcaucaugaagaaccccaccguggacgggaucaccgucaucgaccuggacccgauccccuacgaccccaaguucgagaagcagcucggccaggugaugcugcuggugcucugcgucacccaggugcugaugaugcggaccaccugggcccugugcgaggcccucacccuggcgacggggcccaucuccacccugugggagggcaacccggggcgcuucuggaacaccaccaucgccgugagcauggccaacaucuuccgcggcuccuaccucgccggcgccgggcugcuguucagcaucaugaagaacacggcgaacacccggcgcggcaccgggaacaccggcgagacgcucggcgagaaguggaagaaccggcugaacgcccuggggaaguccgaguuccagaucuacaagaaguccggcauccaggaggucgaccgcacccucgccaaggaggggaucaagcggggcgagaccgaccaccacgccgugucccgcgggagcgcgaagcugcggugguucguggagcgcaaccuggucacccccgagggcaaggugguggaccucggcugcgggcggggcgggugguccuacuacugcggcgggcugaagaacguccgcgaggugaagggccugacgaagggcgggcccggccacgaggagcccaucccgaugagcaccuacggguggaaccucgugcggcugcaguccggcgucgacguguucuucacgccgcccgagaagugcgacacccugcucugcgacaucggggagagcucccccaacccgacgaucgaggccggccgcacccugcgggugcugaaccucgucgagaacuggcugaacaacaacacccaguucugcaucaaggugcugaaccccuacaugcccagcgugaucgagaagauggaggcccugcagcgcaaguacggcggggcccucguccggaacccgcugagccgcaacuccacccacgagauguacugggugagcaacgccuccggcaacaucgugagcuccgucaacaugaucagccggaugcugaucaaccgcuucaccaugcggcacaagaaggcgacguacgagcccgacguggaccucggguccggcacccgcaacaucgggaucgagagcgagacccccaaccuggacaucaucggcaagcgcaucgagaagaucaagcaggagcacgagaccuccuggcacuacgaccaggaccaccccuacaagacgugggccuaccacggcagcuacgagaccaagcagaccggguccgccagcuccauggugaacggcgucgugcggcugcucaccaagccgugggacgugauccccacggucacccagauggccaugaccgacaccacgcccuucgggcagcagcgcguguucaaggagaagguggacacccggacccaggagcccaaggagggcaccaagaagcugaugaagaucacggccgaguggcuguggaaggagcucggcaagaagaagaccccgcgcaugugcacccgggaggaguucacccgcaagguccggagcaacgcggcccugggggccaucuucacggacgagaacaaguggaaguccgcccgcgaggccguggaggacagccgguucugggagcuggucgacaaggagcgcaaccuccaccuggagggcaagugcgagaccugcguguacaacaugauggggaagcgggagaagaagcugggcgaguucgggaaggcgaagggcucccgcgccaucugguacauguggcucggcgcccgguuccuggaguucgaggcccugggguuccucaacgaggaccacugguucagccgcgagaacucccugagcggcguggagggggagggccugcacaagcucggguacauccugcgggacgucagcaagaaggagggcggcgcgauguacgccgacgacaccgccgggugggacacccgcaucacgcuggaggaccucaagaacgaggagauggugaccaaccacauggagggcgagcacaagaagcuggccgaggccaucuucaagcugaccuaccagaacaaggugguccgggugcagcgccccacgccccgggggacggugauggacaucaucucccgccgggaccagcgcggcagcgggcaggucggcaccuacggccucaacaccuucaccaacauggaggcgcagcugauccgccagauggagggggagggcguguucaaguccauccagcaccugacggugaccgaggagaucgccguccagaacuggcucgcccggguggggcgcgagcggcugagccgcauggccaucuccggcgacgacugcguggucaagccccuggacgaccgguucgccagcgcgcucaccgcccugaacgacaugggcaaggugcgcaaggacauccagcagugggagccgucccggggguggaacgacuggacccaggugcccuucugcagccaccacuuccacgagcugaucaugaaggacggccgcguccucguggugcccugccggaaccaggacgagcugaucgggcgcgcccggaucucccagggcgccggguggagccugcgcgagacggccugccucggcaaguccuacgcgcagauguggagccugauguacuuccaccggcgcgaccugcggcucgccgccaacgccaucugcuccgccguccccagccacugggugccgaccucccgcaccaccuggagcauccacgcgcggcacgaguggaugaccacggaggacaugcugaccguguggaaccgcgucuggauccaggagaaccccuggauggaggacaagacccccguggaguccugggaggagauccccuaccugggcaagcgggaggaccaguggugcgggagccucaucggccugaccagccgcgccacgugggccaagaacauccagaccgccaucaaccaggugcgcucccugaucgggaacgaggaguacaccgacuacaugccgagcaugaagcgguuccgccgggaggaggaggaggcgggcguccucugguga

SEQ ID NO: 9743 - RNA, 9876 nt, Artificial Sequence
  derived and/or modified CDS sequence (opt1) from DENV-2__GQ398262__SS-prME
accgccggcaugaucaucaugcugauccccaccgugauggccuuccaccucaccacccgcaacggggagccccacaugaucgugagccggcaggagaagggcaagucccugcuguucaagaccgaggacggggugaacaugugcacccucauggcgauggaccugggcgagcugugcgaggacaccaucaccuacaacugcccccuccugcgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcucgagacccgcaccgagaccuggauguccagcgagggcgccuggaagcacgcccagcggaucgagaccuggauccugcgccaccccggguucacgaucauggcggccauccuggccuacaccaucggcaccaccuacuuccagcggguccucaucuucauccugcugacggccguggcgcccuccaugaccaugcgcugcaucgggaucagcaaccgggacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccgcaaguacugcaucgaggccaagcugaccaacacgaccaccgcgagccggugcccgacccagggggagcccucccugaacgaggagcaggacaagcgcuucgugugcaagcacagcaugguggaccggggcuggggcaacgggugcggccucuucgggaagggcgggaucgucacgugcgccauguucacgugcaagaagaacauggagggcaagguggugcagcccgagaaccuggaguacaccaucgucaucacgccccacuccggcgaggagaacgccguggggaacgacacgggcaagcacgggaaggagaucaagaucaccccgcagagcuccaucaccgaggccgagcugaccggcuacgggaccgugacgauggagugcagcccccgcaccggccucgacuucaacgagaugguccugcugcagauggagaacaaggccuggcucgugcaccggcagugguuccuggaccugccccuccccuggcugccgggcgcggacacccagggguccaacuggauccagaaggagacccuggugacguucaagaacccccacgccaagaagcaggacgucgugguccucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaagguggugaaggagaucgcggagacccagcacggcaccaucgucauccgcgugcaguacgagggggacggcagccccugcaagauccccuucgagaucauggaccuggagaagcggcacgugcucggccgccugaucacggucaacccgaucgugaccgagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgccaagcggauggccauccugggcgacacggccugggacuucgggucccugggcgggguguucaccagcaucggcaaggcgcuccaccagguguucggggccaucuacggcgccgccuucuccggcgucagcuggaccaugaagauccugaucgggguggugaucaccuggaucggcaugaacucccgcagcacgucccugagcgucucccuggugcucgugggggucgugacccuguaccugggcgugaugguccaggcggacagcgggugcgugguguccuggaagaacaaggagcucaagugcggcagcggcaucuucaucaccgacaacguccacaccuggacggagcaguacaaguuccagcccgagagccccuccaagcuggccagcgccauccagaaggcccacgaggaggggaucugcggcauccgguccgugacccgccuggagaaccucauguggaagcagaucacccccgagcugaaccacauccugagcgagaacgaggugcggcucaccaucaugacgggggacaucaagggcaucaugcaggccgggaagcgcucccugcggccgcagcccaccgagcugaaguacagcuggaagaccuggggcaaggcgaagaugcucuccaccgagcugcacaaccagacguuccugaucgacggccccgagaccgccgagugcccgaacaccaaccgcgccuggaacagccucgaggucgaggacuacggguucggcguguucaccacgaacaucuggcugaagcugaaggagcggcaggacguguucugcgacuccaagcucaugagcgccgccaucaaggacaaccgcgcgguccacgccgacaugggguacuggaucgaguccgcccugaacgacaccuggaagaucgagaaggccagcuucaucgaggugaaguccugccacuggcccaagagccacacccugugguccaacggcgugcucgagagcgagaugaucauccccaagaacuucgccggccccgucucccagcacaacuaccggccgggguaccacacccagaccgcgggccccuggcaccuggggaagcuggagauggacuucaacuucugcgagggcacgaccgugguggucaccgaggacugcgggaaccgcggccccagccuccggaccacgaccgccagcggcaagcugaucaccgaguggugcugccgcuccugcacccugcccccgcuccgguaccgcggggaggacggcugcugguacgggauggagauccggccccugaaggagaaggaggagaaccuggugaacagccucgugacggccggccacgggcagaucgacaacuucucccugggcguccugggcauggcccucuuccuggaggagaugcugcgcacccggguggggaccaagcacgcgauccuccugguggccgucagcuucgugacccugaucacgggcaacauguccuuccgcgaccucgggcgcgugauggucauggugggcgccaccaugaccgacgacaucgggaugggcgugaccuaccuggcccugcucgccgcguucaagguccggcccacguucgccgccggccugcugcuccgcaagcugaccagcaaggagcugaugaugaccaccaucgggaucgugcuccugucccagagcacgauccccgagaccauccuggagcucaccgacgcccuggcccugggcaugauggugcucaagaucguccggaacauggagaaguaccagcuggcggugaccaucauggccauccugugcgucccgaacgccgugauccuccagaacgccuggaagguguccugcacgauccuggccgucgugagcgugagcccccugcuccugaccagcucccagcagaaggcggacuggaucccccuggcccucaccaucaaggggcugaaccccaccgccaucuuccugacgacccucagccgcaccuccaagaagcggagcuggccgcugaacgaggccaucauggcggucggcaugguguccauccuggccagcucccuccugaagaacgacauccccaugaccggcccccugguggccgggggccuccugacggucugcuacgugcugaccgggcgcagcgccgaccucgagcuggagcgggccgcggacgugcgcugggaggaccaggccgagaucagcggcuccagccccauccuguccaucaccaucagcgaggacggguccaugagcaucaagaacgaggaggaggagcagacccucacgauccugauccggaccggccugcucgucaucuccggccuguucccggugagcauccccaucaccgccgccgccugguaccugugggaggugaagaagcagcgcgcggggguccucugggacgugcccagcccgccgcccgugggcaaggccgagcuggaggacggggccuaccggaucaagcagaagggcauccugggguacagccagaucggcgccggcgucuacaaggaggggaccuuccacaccauguggcacgugacgcgcggcgccgugcucaugcacaaggggaagcggaucgagcccuccugggcggacgucaagaaggaccugaucagcuacggcgggggcuggaagcuggagggcgaguggaaggagggggaggagguccaggugcucgcccuggagcccggcaagaacccccgcgccguccagaccaagcccgggcuguucaagaccaacaccggcacgaucggggccgugucccucgacuucagccccggcaccuccggcagccccaucguggacaagaaggggaaggucgugggccuguacgggaacggcguggucacccgguccggcaccuacgugagcgccaucgcgcagacggagaaguccaucgaggacaaccccgagaucgaggacgacaucuuccgcaagaagcggcugaccaucauggaccugcaccccggggccggcaagaccaagcgcuaccuccccgccaucgugcgggaggccaucaagcgcgggcugcggacccugauccucgcgccgacgcgcgucguggccgccgagauggaggaggcccugcgcggccugcccauccgguaccagacccccgccauccgcgcggagcacaccgggcgggagaucguggaccucaugugccacgccaccuucacgaugcgccugcugagccccguccgggugccgaacuacaaccucaucaucauggacgaggcccacuucaccgaccccgccagcaucgccgcgcgcggcuacaucuccacccggguggagaugggcgaggccgccgggaucuucaugaccgccacgccgcccggcagccgcgacccguucccccaguccaacgcccccaucauggacgaggagcgggagauccccgagcgcagcuggaacuccgggcacgagugggucaccgacuucaagggcaagaccgugugguucgugccgagcaucaaggcggggaacgacaucgccgccugccugcggaagaacggcaagaaggucauccagcugucccgcaagaccuucgacagcgaguacaucaagacgcggaccaacgacugggacuucguggugaccaccgacaucuccgagaugggcgccaacuucaaggcggagcgcgucaucgacccccggcgcugcaugaagcccgugauccucacggacggggaggagcgggugauccuggccggccccaugccggucacccacagcuccgccgcccagcgccgggggcgcaucggccgcaaccccaagaacgagaacgaccaguacaucuacaugggggagccccuggagaacgacgaggacugcgcccacuggaaggaggcgaagaugcuccuggacaacaucaacacccccgagggcaucaucccgagcauguucgagcccgagcgggagaagguggacgccaucgacggcgaguaccgccugcgcggggaggcccgcaagaccuucguggaccucaugcggcgcggcgaccugcccgucuggcuggccuaccggguggccgcggaggggaucaacuacgccgaccgccgguggugcuucgacggcaucaagaacaaccagauccucgaggagaacgucgagguggagaucuggacgaaggagggggagcgcaagaagcugaagccgcgguggcuggacgcccgcaucuacuccgacccccucgcccugaaggaguucaaggaguucgccgcgggccggaagucccugacccucaaccugaucaccgagaugggccgccugcccaccuucaugacgcagaaggcccggaacgcccucgacaaccuggccgugcugcacaccgcggaggccgggggccgcgccuacaaccacgcccucuccgagcugcccgagacccuggagacccuccugcugcucacgcugcuggccaccgucaccgggggcaucuuccucuuccugaugagcggcaaggggaucggcaagaugacccuggggaugugcugcaucaucaccgcguccauccuccugugguacgcccagauccagccgcacuggaucgccgccagcaucauccuggaguucuuccucaucgugcugcugauccccgagcccgagaagcagcggacgccccaggacaaccagcucaccuacguggucaucgccauccugaccgugguggcggccaccauggccaacgagaugggcuuccuggagaagacgaagaaggacuucgggcucggcuccaucgccacccagcagccggagagcaacauccuggacaucgaccugcgccccgccagcgcguggacccucuacgccgucgccaccacguucaucacccccaugcugcggcacuccaucgagaacagcuccgugaacgugagccugaccgccaucgccaaccaggcgaccguccucaugggccuggggaagggcuggccccuguccaagauggacaucggggugccgcuccuggccaucggcugcuacagccaggugaaccccaucacgcugaccgccgcccuccugcugcucgucgcgcacuacgccaucaucgggcccggccugcaggccaaggccacccgcgaggcccagaagcgggcggccgccggcaucaugaagaaccccaccguggacgggaucacggugaucgaccuggacccgauccccuacgaccccaaguucgagaagcagcucggccaggucaugcugcuggugcucugcgugacccagguccugaugaugcgcaccaccugggcccugugcgaggcccucacgcuggcgaccgggcccaucuccacccugugggagggcaacccggggcgcuucuggaacaccacgaucgccgugagcauggccaacaucuuccggggcuccuaccucgccggcgccgggcugcuguucagcaucaugaagaacaccgcgaacacccgccggggcaccgggaacacgggcgagacccucggcgagaaguggaagaaccgccugaacgcccuggggaaguccgaguuccagaucuacaagaaguccggcauccaggagguggaccggacccucgccaaggaggggaucaagcgcggcgagaccgaccaccacgccgucucccgggggagcgcgaagcugcgcugguucguggagcggaaccuggugacgcccgagggcaaggucguggaccucggcugcgggcgcggcgggugguccuacuacugcggcgggcugaagaacgugcgggaggucaagggccugaccaagggcgggcccggccacgaggagcccaucccgaugagcaccuacggguggaaccucgugcgccugcaguccggcguggacgucuucuucacgccgcccgagaagugcgacacgcugcucugcgacaucggggagagcucccccaacccgaccguggaggccggccggacccugcgcgugcugaaccucgucgagaacuggcugaacaacaacacccaguucugcaucaaggugcugaaccccuacaugcccagcgugaucgagaagauggaggcccugcagcggaaguacggcggggcccucguccgcaacccgcugagccggaacuccacccacgagauguacugggugagcaacgccuccggcaacaucgugagcuccgucaacaugaucagccgcaugcugaucaaccgguucacgaugcgccacaagaaggcgaccuacgagcccgacguggaccucggguccggcacccgcaacaucgggaucgagagcgagacccccaaccuggacaucaucggcaagcggaucgagaagaucaagcaggagcacgagacguccuggcacuacgaccaggaccaccccuacaagaccugggccuaccacggcagcuacgagaccaagcagaccggguccgccagcuccauggugaacggcgucgugcgccugcucacgaagccgugggacgugauccccauggucacccagauggccaugaccgacaccacgcccuucgggcagcagcggguguucaaggagaagguggacacccgcacccaggagcccaaggagggcaccaagaagcugaugaagaucacggccgaguggcuguggaaggagcucggcaagaagaagaccccgcggaugugcacccgcgaggaguucacccggaagguccgcagcaacgcggcccugggggccaucuucacggacgagaacaaguggaaguccgcccgggaggccguggaggacagccgcuucugggagcuggucgacaaggagcggaaccuccaccuggagggcaagugcgagaccugcguguacaacaugauggggaagcgcgagaagaagcugggcgaguucgggaaggcgaagggcucccgggccaucugguacauguggcucggcgcccgcuuccuggaguucgaggcccugggguuccucaacgaggaccacugguucagccgggagaacucccugagcggcguggagggggagggccugcacaagcucggguacauccugcgcgacgucagcaagaaggagggcggcgcgauguacgccgacgacaccgccgggugggacacccggaucacgcuggaggaccucaagaacgaggagauggugaccaaccacauggagggcgagcacaagaagcuggccgaggccaucuucaagcugaccuaccagaacaaggugguccgcgugcagcggcccacgccccgggggacggugauggacaucaucucccggcgcgaccagcgcggcagcgggcaggucggcaccuacggccucaacaccuucaccaacauggaggcgcagcugauccggcagauggagggggagggcguguucaaguccauccagcaccugacggugaccgaggagaucgccguccagaacuggcucgcccgcguggggcgggagcgccugagccggauggccaucuccggcgacgacugcguggucaagccccuggacgaccgcuucgccagcgcgcucaccgcccugaacgacaugggcaaggugcggaaggacauccagcagugggagccgucccgcggguggaacgacuggacccaggugcccuucugcagccaccacuuccacgagcugaucaugaaggacggccggguccucguggugcccugccgcaaccaggacgagcugaucgggcgggcccgcaucucccagggcgccggguggagccugcgggagacggccugccucggcaaguccuacgcgcagauguggagccugauguacuuccaccgccgggaccugcgccucgccgccaacgccaucugcuccgccguccccagccacugggugccgaccucccggaccaccuggagcauccacgcgcgccacgaguggaugaccacggaggacaugcugaccguguggaaccgggucuggauccaggagaaccccuggauggaggacaagacccccguggaguccugggaggagauccccuaccugggcaagcgcgaggaccaguggugcgggagccucaucggccugaccagccgcgccacgugggccaagaacauccagaccgccaucaaccaggugcggucccugaucgggaacgaggaguacaccgacuacaugccgagcaugaagcgcuuccggcgcgaggaggaggaggcgggcguccucugguga

SEQ ID NO: 9744 - RNA, 9876 nt, Artificial Sequence
  derived and/or modified CDS sequence (opt1) from DENV-2__GQ398261__SS-prME
accgcgggcaugaucaucaugcugauccccaccgugauggccuuccaccucaccacccggaacggggagccccacaugaucgucagccggcaggagaagggcaagagccugcuguucaagaccgaggacggggugaacaugugcacccucauggcgauggaccugggcgagcugugcgaggacaccaucaccuacaacugcccccuccugcggcagaacgagcccgaggacaucgacugcuggugcaacagcaccagcaccuggaucacguacgggaccugcaccgccaccggcgagcaccggcgggagaagcggagcguggcccuggucccccacgugggcauggggcucgagacgcgcaccgagaccuggauguccagcgagggcgccuggaagcacgcccagcggaucgagaccuggauccugcggcaccccggguucacgaucauggcggccauccuggccuacaccaucggcaccaccuacuuccagcgggugcucaucuucauccugcugacggccgucgcgcccuccaugaccaugcgcugcaucgggaucagcaaccgggacuucguggagggcguguccggcgggagcugggucgacaucgugcucgagcacggcuccugcgugaccaccauggccaagaacaagcccacgcuggacuucgagcugaucaagaccgaggccaagcagcccgccacccuccgcaaguacugcaucgaggccaagcugaccaacacgaccaccgcgagccggugcccgacccagggggagcccucccugaacgaggagcaggacaagcgcuucgucugcaagcacagcaugguggaccggggcuggggcaacgggugcggccucuucgggaagggcgggaucgugacgugcgccauguucacgugcaagaagaacauggagggcaaggucgugcagcccgagaaccuggaguacaccaucgugaucacgccccacuccggcgaggagaacgccgucgggaacgacacgggcaagcacgggaaggagaucaagaucaccccgcagagcuccaucaccgaggccgagcugaccggcuacgggaccgugacgauggagugcagcccccgcaccggccucgacuucaacgagauggugcugcugcagauggagaacaaggccuggcucguccaccggcagugguuccuggaccugccccuccccuggcugccgggcgcggacacccagggguccaacuggauccagaaggagacccuggugacguucaagaacccccacgccaagaagcaggacguggucgugcucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaaggucgugaaggagaucgcggagacccagcacggcaccaucgugguccgcgugcaguacgagggggacggcagccccugcaagauccccuucgagaucauggaccuggagaagcggcacgugcucggccgccugaucacggucaacccgaucgugaccgagaaggacucccccgugaacaucgaggccgagccgcccuucggggacagcuacaucaucaucggcgucgagccggggcagcugaagcucaacugguucaagaagggcuccagcaucgggcagauguucgagaccaccaugcgcggcgccaagcggauggccauccugggcgacacggccugggacuucgggucccugggcgggguguucaccagcaucggcaaggcgcuccaccagguguucggggccaucuacggcgccgccuucuccggcgucagcuggaccaugaagauccugaucgggguggugaucaccuggaucggcaugaacucccgcagcacgucccugagcgucucccuggugcucgugggggucgugacccuguaccugggcgugaugguccaggcggacagcgggugcgugguguccuggaagaacaaggagcucaagugcggcagcggcaucuucgucaccgacaacgugcacaccuggacggagcaguacaaguuccagcccgagagccccuccaagcuggccagcgccauccagaaggcccacgaggaggggaucugcggcauccgguccgugacccgccuggagaaccucauguggaagcagaucacccccgagcugaaccacauccugagcgagaacgaggucaagcucaccaucaugacgggggacaucaagggcaucaugcaggccgggaagcggucccugcgcccgcagcccaccgagcugaaguacagcuggaagaccuggggcaaggcgaagaugcucuccaccgagcugcacaaccagacguuccugaucgacggccccgagaccgccgagugcccgaacaccaaccgggccuggaacagccucgagguggaggacuacggguucggcguguucaccacgaacaucuggcugaagcugaaggagcgccaggacgucuucugcgacuccaagcucaugagcgccgccaucaaggacaaccgggcggugcacgccgacaugggguacuggaucgaguccgcccugaacgacaccuggaagaucgagaaggccagcuucaucgaggugaaguccugccacuggcccaagagccacacccugugguccaacggcguccucgagagcgagaugaucauccccaagaacuucgccggccccgugucccagcacaacuaccgcccgggguaccacacccagaccgcgggccccuggcaccuggggaagcuggagauggacuucaacuucugcgagggcacgaccguggucgugaccggggacugcggcaaccggggccccgcccuccgcaccacgaccgccagcgggaagcugaucaccgaguggugcugccggagcugcacccugcccccgcuccgcuaccggggcgaggacgggugcugguacggcauggagauccgcccccugaaggagaaggaggagaaccuggugaacucccucgucacggccgggcacggccagaucgacaacuucagccugggcgugcuggggauggcccucuuccuggaggagaugcugcggacccgcgugggcaccaagcacgccauccuccuggucgccguguccuucgugacccugaucacggggaacaugagcuuccgggaccucggccgcgucauggugauggugggggccaccaugaccgacgacaucggcaugggcgucaccuaccuggcccugcucgcggccuucaaggugcgccccacguucgccgccgggcugcugcuccggaagcugaccuccaaggagcugaugaugaccaccaucggcaucgugcuccugagccaguccacgauccccgagaccauccuggagcucaccgacgcccuggcgcuggggaugaugguccucaagaucgugcgcaacauggagaaguaccagcuggccgucaccaucauggccauccugugcgugccgaacgccgugauccuccagaacgccuggaaggucagcugcacgauccuggcggugguguccgucagcccccugcuccugaccuccagccagcagaaggccgacuggaucccccuggcccucaccaucaagggccugaaccccaccgccaucuuccugacgacccucucccggaccagcaagaagcgcuccuggccgcugaacgaggcgaucauggccgugggcauggugagcauccuggccuccagccuccugaagaacgacauccccaugaccgggccccuggucgccggcgggcuccugacggugugcuacgugcugaccggccgguccgccgaccucgagcuggagcgcgcggccgacguccggugggaggaccaggccgagaucagcgggagcucccccauccugagcaucaccaucuccgaggacggcagcauguccaucaagaacgaggaggaggagcagacccucacgauccugauccgcaccggccugcucgugaucagcgggcuguucccgguguccauccccaucaccgccgccgcgugguaccugugggaggucaagaagcagcgggccggcgugcucugggacgugcccagcccgccgcccgucgggaaggccgagcuggaggacggcgccuaccgcaucaagcagaaggggauccugggcuacucccagaucggcgccgggguguacaaggagggcaccuuccacaccauguggcacgugacgcgcggggcgguccucaugcacaagggcaagcgcaucgagcccagcugggccgacgugaagaaggaccugaucuccuacgggggcggcuggaagcuggagggggaguggaaggagggcgaggaggugcagguccucgcccuggagcccgggaagaacccccgggccgugcagaccaagcccggccuguucaagaccaacaccgggacgaucggcgccgugagccucgacuucucccccggcaccagcgggucccccaucgucgacaagaagggcaaggugguggggcuguacggcaacggcgucgugacccgcagcgggaccuacguguccgcgaucgcccagacggagaaguccaucgaggacaaccccgagaucgaggacgacaucuuccggaagaagcgccugaccaucauggaccugcaccccggcgccgggaagaccaagcgguaccuccccgccaucguccgcgaggcgaucaagcggggccugcgcacccugauccucgccccgacgcgggugguggccgccgagauggaggaggcccugcgcgggcugcccauccgcuaccagacccccgcgauccgggccgagcacaccggccgcgagaucgucgaccucaugugccacgccaccuucacgaugcggcugcugucccccgugcgcgugccgaacuacaaccucaucaucauggacgaggcccacuucaccgaccccgccagcaucgcggcccggggcuacaucagcacccgcgucgagaugggggaggccgccggcaucuucaugaccgccacgccgcccgggucccgggacccguucccccagagcaacgcgcccaucauggacgaggagcgcgagauccccgagcgguccuggaacagcggccacgagugggugaccgacuucaaggggaagaccgugugguucgucccguccaucaaggccggcaacgacaucgccgccugccugcgcaagaacggcaagaaggugauccagcugagccggaagaccuucgacuccgaguacaucaagacgcgcaccaacgacugggacuucguggucaccaccgacaucagcgagaugggggcgaacuucaaggccgagcgggugaucgacccccgccggugcaugaagcccgugauccucacggacggcgaggagcgcgucauccuggccgggcccaugccggugacccacuccagcgccgcccagcggcgcggccggaucgggcgcaaccccaagaacgagaacgaccaguacaucuacaugggcgagccccuggagaacgacgaggacugcgcgcacuggaaggaggccaagaugcuccuggacaacaucaacacccccgagggcaucaucccguccauguucgagcccgagcgcgagaagguggacgccaucgacggggaguaccggcugcgcggcgaggcccggaagaccuucgucgaccucaugcgccgcggggaccugcccguguggcuggccuaccgcgucgcggccgagggcaucaacuacgccgaccggcgcuggugcuucgacgggaucaagaacaaccagauccucgaggagaacguggagguggagaucuggacgaaggagggcgagcggaagaagcugaagccgcgcuggcuggacgcccggaucuacagcgacccccucgcccugaaggaguucaaggaguucgcggccggccgcaagucccugacccucaaccugaucaccgagaucgggcggcugcccaccuucaugacgcagaaggcccgcaacgcccucgacaaccuggcgguccugcacaccgccgaggccggcgggcgggccuacaaccacgcccucagcgagcugcccgagacccuggagacccuccugcugcucacgcugcuggcgaccgugaccggcggcaucuuccucuuccugauguccgggaagggcaucgggaagaugacccugggcaugugcugcaucaucaccgccagcauccuccugugguacgcccagauccagccgcacuggaucgccgccuccaucauccuggaguucuuccucaucgugcugcugauccccgagcccgagaagcagcgcacgccccaggacaaccagcucaccuacgucgugaucgcgauccugaccguggucgccgccaccauggccaacgagaugggguuccuggagaagacgaagaaggacuucggccucggcagcaucgccacccagcagccggaguccaacauccuggacaucgaccugcggcccgcgagcgccuggacccucuacgccguggccaccacguucaucacccccaugcugcgccacagcaucgagaacuccagcgugaacgucucccugaccgccaucgcgaaccaggccaccgugcucauggggcugggcaagggguggccccugagcaagauggacaucggcgugccgcuccuggccaucgggugcuacucccaggucaaccccaucacgcugaccgccgcgcuccugcugcucguggcccacuacgccaucaucggccccggccugcaggccaaggccacccgggaggcgcagaagcgcgccgccgccgggaucaugaagaaccccaccguggacggcaucacggucaucgaccuggacccgauccccuacgaccccaaguucgagaagcagcucggccaggugaugcugcuggugcucugcgucacccaggugcugaugaugcggaccaccugggcccugugcgaggcgcucacgcuggccaccggccccaucagcacccugugggaggggaacccgggccgcuucuggaacaccacgaucgccguguccauggccaacaucuuccgcggcagcuaccucgccggggcgggccugcuguucuccaucaugaagaacaccgccaacacccggcgcgggaccggcaacacgggcgagacccucggggagaaguggaagaaccggcugaacgcccugggcaagagcgaguuccagaucuacaagaaguccgggauccaggaggucgaccgcacccucgccaaggagggcaucaagcgcggggagaccgaccaccacgcggugagccgcggcuccgccaagcugcggugguucguggagcgcaaccuggucacgcccgagggcaaggugguggaccucgggugcggccgcggcggguggagcuacuacugcggcgggcugaagaacguccgcgaggugaaggggcugaccaagggcgggcccgggcacgaggagcccaucccgauguccaccuacggcuggaaccucgugcggcugcagagcggggucgacguguucuucacgccgcccgagaagugcgacacgcugcucugcgacaucggcgaguccagccccaacccgaccaucgaggccggccgcacccugcgggugcugaaccucgucgagaacuggcugaacaacaacacccaguucugcaucaaggugcugaaccccuacaugcccuccgugaucgagaagauggaggcccugcagcgcaaguacgggggcgcccucguccggaacccgcugagccgcaacagcacccacgagauguacuggguguccaacgcgagcgggaacaucguguccagcgucaacaugaucucccggaugcugaucaaccgcuucacgaugcggcacaagaaggccaccuacgagcccgacguggaccucggcagcgggacccgcaacaucggcaucgaguccgagacccccaaccuggacaucaucggcaagcgcaucgagaagaucaagcaggagcacgagacgagcuggcacuacgaccaggaccaccccuacaagaccugggccuaccacggguccuacgagaccaagcagaccggcagcgccuccagcauggugaacggggucgugcggcugcucacgaagccgugggacgugauccccaccgucacccagauggccaugaccgacacgacccccuucggccagcagcgcguguucaaggagaagguggacacccggacccaggagcccaaggagggcacgaagaagcugaugaagaucaccgcggaguggcuguggaaggagcucgggaagaagaagaccccgcgcaugugcacccgggaggaguucacgcgcaagguccgguccaacgccgcccugggcgccaucuucaccgacgagaacaaguggaaguccgcccgcgaggcgguggaggacucccgguucugggagcuggucgacaaggagcgcaaccuccaccuggaggggaagugcgagaccugcguguacaacaugaugggcaagcgggagaagaagcugggggaguucggcaaggccaagggcagccgcgccaucugguacauguggcucggggcccgguuccuggaguucgaggcgcugggcuuccucaacgaggaccacugguucucccgcgagaacagccuguccgggguggagggcgaggggcugcacaagcucggcuacauccugcgggacgucagcaagaaggagggcggggccauguacgccgacgacaccgccggcugggacacgcgcaucacccuggaggaccucaagaacgaggagauggugaccaaccacauggagggggagcacaagaagcuggccgaggcgaucuucaagcugaccuaccagaacaaggugguccgggugcagcgccccacgccccggggcaccgugauggacaucaucagccgccgggaccagcgcggguccggccaggucggcaccuacgggcucaacaccuucacgaacauggaggcccagcugauccgccagauggagggcgaggggguguucaagagcauccagcaccugaccgugaccgaggagaucgccguccagaacuggcucgcccgggugggccgcgagcggcugucccgcauggccaucagcggcgacgacugcguggucaagccccuggacgaccgguucgcguccgcccucaccgcccugaacgacauggggaaggugcgcaaggacauccagcagugggagccgagccggggcuggaacgacuggacccaggugcccuucugcucccaccacuuccacgagcugaucaugaaggacgggcgcguccucguggugcccugccggaaccaggacgagcugaucggccgcgcccggaucagccagggggccggcuggucccugcgcgagaccgcgugccucggcaagagcuacgcccagauguggucccugauguacuuccaccggcgcgaccugcggcucgccgccaacgccaucugcagcgcgguccccucccacugggugccgaccagccgcaccaccugguccauccacgcccggcacgaguggaugacgaccgaggacaugcugaccguguggaaccgcgucuggauccaggagaaccccuggauggaggacaagacccccguggagagcugggaggagauccccuaccuggggaagcgggaggaccaguggugcggcucccucaucgggcugacgagccgcgccaccugggccaagaacauccagaccgcgaucaaccaggugcgcagccugaucggcaacgaggaguacaccgacuacaugccguccaugaagcgguuccgccgggaggaggaggaggccgggguccucugguga

SEQ ID NO: 9745 - RNA, 9876 nt, Artificial Sequence
  derived and/or modified CDS sequence (opt1) from DENV-2__GQ398313__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucgcggagaaggacagccccgugaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcgcugcaccagguguucggcgccaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggcgaugguccaggccgacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggcgggcaagcggucccugcgcccgcagcccaccgagcucaaguacagcuggaagaccuggggcaaggccaagaugcuguccaccgagagccacaaccagacguuccugaucgacgggcccgagaccgccgagugcccgaacaccaaccgggccuggaacucccucgaggucgaggacuacggcuucgggguguucaccacgaacaucuggcugaagcugcgcgagaagcaggacguguucugcgacagcaagcucauguccgccgcgaucaaggacaaccgggccguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgcggggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgccuccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccaugcuccugguggccgucuccuucgugacccugaucacggggaacaugagcuuccgggaccucggccgcgugauggucauggugggggccaccaugaccgacgacaucggcaugggcaucaccuaccuggcccugcucgcggccuucaaggugcgccccacguucgccgccgggcugcugcuccggaagcugaccuccaaggagcugaugauggccaccaucggcaucgcgcuccugagccaguccaccauccccgagacgauccuggagcucaccgacgcccuggcccuggggaugaugguccucaagaucgugcgcaacauggagaaguaccagcuggccgugaccaucauggccaucagcugcgucccgaacgcggugauccugcagaacgccuggaagguguccugcaccauccucgccgccgucagcgugagcccccugcugcucacgagcucccagcagaaggcggacuggaucccccuggcccugaccaucaagggccucaaccccaccgccaucuuccugaccacgcugagccggaccuccaagaagcgcagcuggccgcucaacgaggccgucauggccgugggcaugguguccauccuggcgagcagccugcucaagaacgacauccccaugaccgggccccuggucgccggcgggcugcucaccgugugcuacgugcugacgggccgguccgccgaccuggagcucgagcgcgccgccgacgucaagugggaggaccaggcggagaucagcggguccagccccauccuguccaucaccaucagcgaggacggcuccaugagcaucaagaacgaggaggaggagcagacccugaccauccucauccggacgggccugcuggugaucuccgggguguucccggucagcauccccaucaccgccgccgccugguaccucugggaggugaagaagcagcgcgccggcgugcugugggacguccccagcccgccgcccguggggaaggcggagcuggaggacggcgccuaccggaucaagcagcgcgggauccucggcuacagccagaucggcgccgggguguacaaggagggcaccuuccacaccauguggcacgucacccgcggggcggugcugaugcaccgcggcaagcggaucgagcccuccugggccgacgugaagaaggaccugaucagcuacgggggcggcuggaagcucgagggggaguggaaggagggcgaggagguccaggugcuggcgcuggagcccgggaagaacccccgcgccgugcagacgaagcccggccucuucaagaccaacaccgggaccaucggcgccgucucccuggacuucagccccggcacguccgggagccccaucguggaccggaagggcaagguggucgggcuguacggcaacggcguggugacccgcuccggggccuacgucagcgcgaucgcccagaccgagaaguccaucgaggacaaccccgagaucgaggacgacaucuuccggaagaagcgccucaccaucauggaccugcaccccggcgccgggaagacgaagcgguaccugcccgccaucgugcgcgaggccaucaagcggggccugcgcacccucauccuggcgccgacccgcguggucgccgccgagauggaggaggcccugcgggggcuccccauccgcuaccagacccccgccauccgggcggagcacacgggccgcgagaucguggaccugaugugccacgccaccuucaccaugcggcugcucucccccgugcgcgucccgaacuacaaccugaucaucauggacgaggcccacuucaccgaccccgccagcaucgccgcgcggggcuacaucuccacgcgcguggagaugggggaggccgccggcaucuucaugaccgccacgccgcccgggagccgggacccguucccccaguccaacgcgcccaucauggacgaggagcgcgagauccccgagcggagcuggaacuccggccacgagugggugaccgacuucaaggggaagacggucugguucgugccgagcaucaaggccggcaacgacaucgccgccugccugcgcaagaacggcaagaaggugauccagcucucccggaagaccuucgacagcgaguacgucaagacccgcgccaacgacugggacuucguggugaccacggacaucuccgagaugggggcgaacuucaaggccgagcgggucaucgacccccgccggugcaugaagcccgugauccugaccgacggcgaggagcgcgugauccuggccgggcccaugccggucacccacagcuccgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccgagcauguucgagcccgagcgcgagaagguggacgccaucgacggggaguaccggcuccgcggcgaggcccggaagacguucguggaccugaugcgccgcggggaccugcccgucuggcucgccuaccgcguggcggccgagggcaucaacuacgccgaccggcgcuggugcuucgacgggaucaagaacaaccagauccuggaggagaacguggaggucgagaucuggaccaaggagggcgagcggaagaagcugaagccgcgcuggcucgacgcccggaucuacuccgacccccuggcgcugaaggaguucaaggaguucgccgccggccgcaagagccucacccugaaccugaucaccgagauggggcggcuccccacguucaugacccagaaggcccgcgacgcccuggacaaccuggcggugcuccacaccgccgaggccggcgggcgggccuacaaccacgcccuguccgagcugcccgagacccucgagacgcugcugcuccugacccugcucgcgaccgucaccggcggcaucuuccuguuccugaugagcgggaagggcaucgggaagaugacgcucggcaugugcugcaucaucaccgccuccauccugcugugguacgcccagauccagccgcacuggaucgccgccagcaucauccucgaguucuuccugaucgugcugcucauccccgagcccgagaagcagcgcacgccccaggacaaccagcugaccuacguggucaucgcgauccugaccgugguggccgccacgauggccaacgagaugggguuccucgagaagaccaagaaggaccugggccugggcagcaucgccacccaggaguccgagagcaacauccucgacaucgaccugcggccggcguccgccuggacccuguacgccgucgccacgaccuucgugacccccaugcuccgccacagcaucgagaacuccagcgugaacgucucccugaccgcgaucgccaaccaggccacggugcugauggggcucggcaagggguggccccugagcaagauggacaucggcgugccccugcucgccaucgggugcuacucccaggucaacccgaucacccugaccgccgcgcugcuccugcugguggcccacuacgccaucaucggccccggccuccaggccaaggccacccgggaggcgcagaagcgcgccgccgccgggaucaugaagaaccccacgguggacggcaucaccgucaucgaccuggagcccaucccguacgaccccaaguucgagaagcagcuggggcaggucaugcuccugauccugugcgugacccagguccucaugaugcgcaccacgugggcccugugcgaggcgcugacccucgccaccggccccaucagcacccugugggaggggaaccccggccgguucuggaacacgaccaucgccguguccauggccaacaucuuccgcggcagcuaccuggcgggggccggccuccuguucuccaucaugaagaacaccaccaacacgcggcgcgggaccggcaacaucggcgagacccugggggagaaguggaagucccggcucaacgcccugggcaaguccgaguuccagaucuacaagaaguccgggauccaggagguggaccgcacccuggccaaggagggcaucaagcgcggggagacggaccaccacgccgucucccgcggcagcgcgaagcuccggugguucguggagcgcaacauggugaccccggagggcaaggucguggaccuggggugcggccgcggcgggugguccuacuacugcggcgggcugaagaacgugcgcgaggucaaggggcucaccaagggcgggcccgggcacgaggagcccauccccaugagcaccuacggcuggaaccuggugcggcugcagagcgggguggacgucuucuucacgccgcccgagaagugcgacacccuccugugcgacaucggcgaguccagccccaaccccaccaucgaggccggccgcacccugcgggugcucaaccugguggagaacuggcugaacaacaacacgcaguucugcaucaagguccucaacccguacaugcccuccgugaucgagaagauggagacccugcagcgcaaguacgggggcgcccuggugcggaacccccugagccgcaacuccacccacgagauguacugggucagcaacgccaccgggaacaucguguccagcgugaacaugaucucccggaugcucaucaaccgcuucaccaugaagcacaagaaggccacguacgagccggacgucgaccugggcagcgggacccgcaacaucggcaucgaguccgagauccccaaccuggacaucaucggcaagcggaucgagaagaucaagcaggagcacgagaccagcuggcacuacgaccaggaccaccccuacaagaccugggcguaccacggguccuacgagacgaagcagaccggcagcgccuccagcauggugaacggggugguccgccuccugaccaagcccugggacguggugccgauggucacccagauggccaugacggacaccacccccuucggccagcagcggguguucaaggagaagguggacacccgcacgcaggagcccaaggagggcaccaagaagcugaugaagaucaccgccgaguggcucuggaaggagcuggggaagaagaagacgccccggaugugcacgcgcgaggaguucacccggaagguccgcuccaacgccgcgcugggcgccaucuucaccgacgagaacaaguggaaguccgcccgggaggccguggaggacucccgcuucugggagcucaucgaccgggagcgcaaccugcaccuggaggggaagugcgagaccugcguguacaacaugaugggcaagcgggagaagaagcucggggaguucggcaaggcgaagggcagccgcgccaucugguacauguggcugggggcccgguuccuggaguucgaggcccucggcuuccugaacgaggaccacugguucagccgcgggaacucccugagcggcgucgagggggagggccuccaccggcugggcuacauccugcgcgacguguccaagaaggagggcggggccauguacgcggacgacacggccgggugggacacccggaucacccucgaggaccugaagaacgaggagauggucaccaaccacaugaagggcgagcacaagaagcuggccgaggccaucuucaagcucacguaccagaacaagguggugcgcguccagcggccgacgccccgggggaccgugauggacaucaucagccgccgggaccagcgcggcuccggccagguggggaccuacggccugaacacguucaccaacauggaggcccagcugauccggcagauggagggggagggcaucuucaagagcauccagcaccucaccgucaccgaggagaucgcggugcagaacuggcuggcccgcgugggccgggagcgccugucccggauggccaucagcggggacgacugcgucgugaagccccucgacgaccgcuucgccuccgcccugacggcgcugaacgacaugggcaaggugcggaaggacauccagcagugggagcccagccgcggguggaacgacuggacccaggucccguucugcucccaccacuuccacgagcucgugaugaaggacggccgggugcuggucgugcccugccgcaaccaggacgagcugaucgggcgggcccgcaucagccagggcgccggcuggucccucaaggagaccgccugccugggcaagagcuacgcccagauguggacccugauguacuuccaccggcgcgaccuccggcuggcggccaacgccaucugcuccgccgugcccagccacuggguccccacgucccgcaccaccuggagcauccacgcgaagcacgaguggaugaccaccgaggacaugcuggccguguggaaccggguguggauccaggagaacccguggauggaggacaagacgcccgucgagagcugggaggaggugcccuaccucggcaagcgcgaggaccaguggugcgggucccugaucggccugaccagccgcgccaccugggccaagaacauccagaccgccaucaaccaggugcggucccucaucgggaacgaggaguacacggacuacaugcccagcaugaagcgcuuccggcgcgaggaggaggaggcgggcguccugugguga

SEQ ID NO: 9746 - RNA, 9876 nt, Artificial Sequence
  derived and/or modified CDS sequence (opt1) from DENV-2__GQ398285__SS-prME
accgcgggcgugaucaucaugcugauccccaccgccauggcguuccaccucaccacccgcaacggggagccgcacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaugggccuggacuucaacgagaugguccugcuccagauggaggacaaggccuggcuggugcaccggcagugguuccuggaccucccccugcccuggcugccgggggccgacacccagggcagcaacuggauccagaaggagacccucgugacguucaagaacccccacgcgaagaagcaggacgucgugguccuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgugaaggagaucgccgagacccagcacgggaccaucgugauccgcguccaguacgagggcgacggcucccccugcaagauccccuucgagaucauggaccucgagaagcggcacgugcuggggcgccugaucacggugaacccgaucgucaccgagaaggacagccccgugaacaucgaggcggagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcccugcaccagguguucggcaccaucuacggcgcggccuucagcgggguguccuggaccaugaagauccugaucggcgucaucaucacguggaucgggaugaacagccgcuccaccagccuguccgugagccucgugcuggucggcguggugacccuguaccucggggccaugguccaggccgacuccggcugcguggugagcuggaaguccaaggagcugaagugcggcagcgggaucuucaucaccgacaacguccacacguggaccgagcaguacaaguuccagcccgagagccccuccaagcuggcgagcgccauccagaaggcccacgaggagggcaucugcgggauccgguccgugacccgccucgagaaccugauguggaagcagaucacccccgagcugaaccacauccucagcgagaacgaggugaagcugacgaucaugaccggcgggaucaagggcaucaugcaggccggcaagcggucccugcgcccgcagcccaccgagcucaaguacagcuggaagaccugggggaaggccaagaugcuguccacggagagccacaaccagaccuuccugaucgacggccccgagaccgcggagugcccgaacaccaaccgggccuggaacucccucgaggucgaggacuacggguucggcguguucacgaccaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggggugcucgaguccgagaugaucauccccaagaaccuggccggccccgugagccagcacaacuaccgcccgggguaccacacccagacggccggccccuggcaccuggggaagcucgagauggacuucgacuucugcgagggcaccaccgugguggucaccgaggacugcggcaaccgggggcccagccugcgcacgaccaccgcguccggcaagcuggugaccgaguggugcugccggagcugcacgcucccgccccugcgcuaccgcggggaggacggcugcugguacgggauggagauccgcccccugaaggagaaggaggagaaccucgugaacucccuggucaccgccggccacggccagaucgacaacuucagccugggggugcucggcauggcccuguuccuggaggagaugcuccggacccgcguggggaccaagcacgccauccugcuggucgcgguguccuucgugacgcucaucaccggcaacaugagcuuccgggaccuggggcgcgucauggugauggugggcgccaccaugaccgacgacaucggcaugggggucacguaccuggcccuccuggccgccuucaaggugcgccccaccuucgcggccggccugcuccugcggaagcugaccuccaaggagcucaugauggccaccaucgggaucgcccugcugagccaguccacgauccccgagaccauccucgagcugaccgacgcccuggcgcucggcaugauggugcugaagaucguccgcaacauggagaaguaccagcuggccgugaccaucauggccaucagcugcgugcccaacgccgucauccuccagaacgccuggaagguguccugcacgauccuggcggccgucagcgugagcccccugcuccugaccagcucccagcagaaggccgacuggaucccccuggcccucaccaucaagggccugaaccccaccgcgaucuuccugacgacccucagccggaccuccaagaagcgcagcuggccgcugaacgaggccaucauggccguggggauggucuccauccuggccagcagccuccugaagaacgacauccccaugaccggcccccugguggccgggggccuccugacggugugcuacguccugaccgggcgguccgcggaccucgagcuggagcgcgccgccgacgugaagugggaggaccaggccgagaucagcggcuccagccccauccuguccaucaccaucagcgaggacggcuccaugagcaucaagaacgaggaggaggagcagacccucacgauccugauccggaccgggcugcucgugaucuccggcgucuucccggugagcauccccaucaccgccgcggccugguaccugugggaggugaagaagcagcgcgccgggguccugugggacgugcccagcccgccgcccgugggcaaggccgagcucgaggacggggccuaccggaucaagcagcgcggcauccugggcuacagccagaucggggcgggcgucuacaaggaggggaccuuccacaccauguggcacgugacgcggggcgccgugcugaugcaccgcgggaagcggaucgagcccuccugggccgacgucaagaaggaccucaucagcuacggcggcggguggaagcuggagggcgaguggaaggagggggaggagguccaggugcuggcccucgagcccggcaagaacccccgcgccguccagaccaagcccgggcuguucaagaccaacaccggcacgaucggcgcggugucccuggacuucagccccgggaccuccggcagccccaucguggaccggaaggggaaggucgugggccucuacggcaacgggguggucacccgcuccggcgccuacgugagcgccaucgcccagaccgagaaguccaucgaggacaaccccgagaucgaggacgacaucuuccggaagaagcgccugacgaucauggaccugcaccccggggcgggcaagaccaagcgguaccugcccgccaucgugcgcgaggccaucaagcgggggcuccgcacccugauccuggccccgacccgcgucguggccgcggagauggaggaggcccuccggggccugcccauccgcuaccagacgcccgccauccgggccgagcacaccggccgcgagaucguggaccugaugugccacgccaccuucaccaugcggcuccugucccccguccgcgugccgaacuacaaccugaucaucauggacgaggcgcacuucacggaccccgccagcaucgccgcccggggguacaucuccacccgcguggagaugggcgaggccgcggggaucuucaugaccgccacgccgcccggcagccgggacccguucccccaguccaacgcccccaucauggacgaggagcgcgagauccccgagcggagcuggaacuccgggcacgagugggucacggacuucaagggcaagaccgugugguucgugccgagcaucaaggccggcaacgacaucgcggccugccuccgcaagaacgggaagaaggucauccagcugucccggaagaccuucgacagcgaguacgugaagacccgcgccaacgacugggacuucguggucacgaccgacaucuccgagaugggcgccaacuucaaggccgagcgggugaucgacccccgccggugcaugaagcccgugauccugaccgacggggaggagcgcgucauccucgcgggccccaugccggugacccacagcuccgccgcccagcggcgcgggcgcaucggccggaaccccaagaacgagaacgaccaguacaucuacaugggcgagccccuggagaacgacgaggacugcgcccacuggaaggaggccaagaugcugcucgacaacaucaacacgcccgaggggaucaucccgagcauguucgagcccgagcgcgagaagguggacgcgaucgacggcgaguaccggcugcgcggggaggcccggaagaccuucgucgaccugaugcgccggggcgaccuccccguguggcuggccuaccgcguggccgccgaggggaucaacuacgcggaccggcgcuggugcuucgacggcaucaagaacaaccagauccuggaggagaacgucgagguggagaucuggaccaaggagggcgagcggaagaagcucaagccgcgcuggcuggacgcccggaucuacuccgacccccuggcccucaaggaguucaaggaguucgccgcggggcgcaagagccugacccugaaccucaucacggagaugggccggcugcccaccuucaugacccagaaggcccgcaacgcccuggacaaccucgccguccugcacaccgccgaggccggcgggcgggccuacaaccacgcccuguccgagcuccccgagacgcuggagacccugcuccugcugacccuccuggccaccgugacgggcgggaucuuccuguuccucaugagcgggaaggggaucggcaagaugacccuggggaugugcugcaucaucaccgccuccauccugcucugguacgcgcagauccagccgcacuggaucgccgccagcaucauccuggaguucuuccugaucgugcuccugauccccgagcccgagaagcagcgcacgccccaggacaaccagcugaccuacgucgugaucgccauccucacgguggucgccgcgaccauggccaacgagaugggcuuccuggagaagaccaagaaggaccugggccucgggagcaucaccacgcaggaguccgagagcaacauccuggacaucgaccugcggccggccuccgccuggacccucuacgccguggcgaccaccuucgugacgcccaugcugcgccacagcaucgagaacuccagcgucaacgugucccugaccgccaucgccaaccaggccaccgugcucaugggccuggggaagggcuggccccugagcaagauggacaucggggucccccuccuggcgaucggcugcuacucccaggugaacccgaucacccugacggccgcccuccugcugcucguggcccacuacgccaucaucggccccgggcugcaggcgaaggccacccgggaggcccagaagcgcgccgccgcgggcaucaugaagaaccccaccgucgacgggaucaccgugaucgaccuggagcccaucccguacgaccccaaguucgagaagcagcucggccaggugaugcugcugauccucugcgucacccaggugcugaugaugcgcaccaccugggcccugugcgaggcccucacccuggccacggggcccaucagcacccugugggagggcaaccccggccgguucuggaacaccaccaucgccguguccauggcgaacaucuuccgcgggagcuaccucgccggcgccgggcugcuguucuccaucaugaagaacacgaccaacacccggcgcggcaccggcaacaucggggagacgcucggcgagaaguggaagucccggcugaacgcccugggcaagagcgaguuccagaucuacaagaaguccgggauccaggaggucgaccgcacccucgcgaaggaggggaucaagcggggcgagaccgaccaccacgccgugucccgcggcagcgccaagcugcggugguucguggagcgcaacauggucaccccggaggggaaggugguggaccugggcugcgggcggggcgggugguccuacuacugcggcggccucaagaacguccgcgaggugaaggggcugacgaagggcgggcccggccacgaggagcccauccccaugagcaccuacggguggaaccuggugcggcuccagagcggcgucgacguguucuucaccccgcccgagaagugcgacacccugcugugcgacaucggcgaguccagccccaaccccacgaucgaggccgggcgcacccuccgggugcugaaccuggucgagaacuggcucaacaacaacacccaguucugcaucaaggugcugaacccguacaugcccuccgugaucgagaagauggagacccugcagcgcaaguacggcggggcccugguccggaacccccucagccgcaacuccacccacgagauguacugggugagcaacgcgacgggcaacaucguguccagcgucaacaugaucucccggaugcugaucaaccgcuucaccaugaagcacaagaaggccaccuacgagccggacguggaccuggggagcggcacccgcaacaucggcaucgaguccgagauccccaaccucgacaucaucgggaagcggaucgagaagaucaagcaggagcacgagacgagcuggcacuacgaccaggaccaccccuacaagaccugggccuaccacggcuccuacgagaccaagcagaccgggagcgccuccagcauggugaacggcgucgugcgccugcugacgaagcccugggacguggucccgauggugacccagauggccaugaccgacaccacgcccuucggccagcagcggguguucaaggagaaggucgacacccgcacccaggagcccaaggaggggaccaagaagcucaugaagaucacggcggaguggcuguggaaggagcugggcaaggagaagacgccccggaugugcacccgcgaggaguucgcccggaaggugcgcuccaacgccgcccucggggccaucuucaccgacgagaacaaguggaaguccgcgcgggaggccguggaggacucccgcuucugggagcugaucgaccgggagcgcaaccugcaccucgagggcaagugcgagacgugcgucuacaacaugauggggaagcgggagaagaagcugggcgaguucggcaaggccaaggggagccgcgccaucugguacauguggcugggcgcgcgguuccucgaguucgaggcccugggguuccugaacgaggaccacugguucagccgcgagaacucccucagcggcguggagggggagggccugcaccggcugggcuacauccuccgcgacgucuccaagaaggagggcggggccauguacgccgacgacaccgccgggugggacacccggaucacccuggaggaccugaagaacgaggagauggugacgaaccacaugaagggcgagcacaagaagcucgcggaggccaucuucaagcugaccuaccagaacaaggugguccgcgugcagcggccgacgccccgcgggaccgugauggacaucaucagccgccgggaccagcgcggcuccggccaggucgggaccuacggccugaacaccuucaccaacauggaggcccagcucauccggcagauggagggggagggcaucuucaagagcauccagcaccugaccgccacggaggagaucgccgugcagaacuggcuggcgcgcgugggccgggagcgccucucccggauggccaucagcggggacgacugcgucgugaagccccuggacgaccgcuucgccuccgcccugaccgcccucaacgacaugggcaaggugcggaaggacauccagcagugggagcccagccgcggguggaacgacuggacccaggucccguucugcucccaccacuuccacgagcuggugaugaaggacggccgggugcuggucgugcccugccgcaaccaggacgagcucaucgggcgggcgcgcaucagccagggcgccggcuggucccugaaggagaccgccugccugggcaagagcuacgcccagauguggacgcucauguacuuccaccggcgcgaccugcggcuggccgcgaacgccaucugcuccgccgugcccagccacuggguccccaccucccgcaccaccuggagcauccacgccaagcacgaguggaugaccacggaggacaugcucgcgguguggaaccggguguggauccaggagaacccguggauggaggacaagacccccgucgagagcugggaggaggugcccuaccugggcaagcgcgaggaccaguggugcgggucccugaucggccucaccagccgcgccaccugggccaagaacauccagacggccaucaaccaggugcggucccugaucgggaacgaggaguacaccgacuacaugcccagcaugaagcgcuuccggcgcgaggaggaggaggccggcguccugugguga

SEQ ID NO: 9747 - RNA, 9876 nt, Artificial Sequence
  derived and/or modified CDS sequence (opt1) from DENV-2__GQ398298__SS-prME
accgccggggugaucaucaugcugauccccaccgccauggcguuccaccucaccacccgcaacggggagccccacaugaucgucgggcggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucagcaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucgcggagaaggacagccccgugaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcgcugcaccagguguucggcgccaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggcgaugguccaggccgacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggcgggcaagcggucccugcgcccgcagcccaccgagcucaaguacagcuggaagaccuggggcaaggccaagaugcuguccaccgagagccacaaccagacguuccugaucgacgggcccgagaccgccgagugcccgaacaccaaccgggccuggaacucccucgaggucgaggacuacggcuucgggguguucaccacgaacaucuggcugaagcugcgcgagaagcaggacguguucugcgacagcaagcucauguccgccgcgaucaaggacaaccgggccguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgcggggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgccuccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggccugcucgggauggcgcuguuccuggaggagaugcuccggacccgcgucggcaccaagcacgccaugcugcuggugguggucuccuucgugacccucaucacggggaacaugagcuuccgggaccugggccgcgugauggucauggugggggccaccaugaccgacgacaucggcaugggcaucaccuaccuggcccuccuggccgcguucaaggugcgccccacguucgccgccgggcugcuccugcggaagcugaccuccaaggagcucaugauggccaccaucggcaucgcccugcugagccaguccaccauccccgagacgauccucgagcugaccgacgcgcuggcccucgggaugaugguccugaagaucgugcgcaacauggagaaguaccagcuggccgugaccaucauggccaucagcugcgucccgaacgccgugauccuccagaacgcguggaagguguccugcaccauccuggccgccgucagcgugagcccccugcuccugacgagcucccagcagaaggccgacuggaucccccuggcgcucaccaucaagggccugaaccccaccgccaucuuccugaccacgcucagccggaccuccaagaagcgcagcuggccgcugaacgaggccaucauggccgucggcaugguguccauccuggccagcagccuccugaagaacgacauccccaugaccgggccccugguggcgggcgggcuccugaccgucugcuacgugcugacgggccgguccgccgaccucgagcuggagcgcgccgccgacgugaagugggaggaccaggccgagaucagcggguccagccccauccuguccaucaccaucagcgaggacggcuccaugagcaucaagaacgaggaggaggagcagacccucaccauccugauccggacgggccugcucgucaucuccgggguguucccggugagcauccccaucaccgcggccgccugguaccugugggaggucaagaagcagcgcgccggcgugcugugggacgugcccagcccgccgcccgucgggaaggccgagcucgaggacggcgcguaccggaucaagcagcgcgggauccugggcuacagccagaucggcgccgggguguacaaggagggcaccuuccacaccauguggcacgugacccgcggggccguccugaugcaccgcggcaagcggaucgagcccuccugggccgacaucaagaaggaccucaucagcuacgggggcggcuggaagcuggagggggaguggaaggagggcgaggagguccaggugcuggcccucgagcccgggaagaacccccgcgcgguccagacgaagcccggccuguucaagaccaacaccgggaccaucggcgccgugucccuggacuucagccccggcacguccgggagccccaucguggaccggaagggcaaggucguggggcucuacggcaacggcguggucacccgcuccggggccuacgugagcgccaucgcgcagaccgagaaguccaucgaggacaaccccgagaucgaggacgacaucuuccggaagaagcgccugaccaucauggaccugcaccccggcgccgggaagacgaagcgguaccugcccgccaucgugcgcgaggccaucaagcggggccuccgcacccugauccuggccccgacccgcgucguggcggccgagauggaggaggcccuccgggggcugcccauccgcuaccagacccccgccauccgggccgagcacacgggccgcgagaucguggaccugaugugccacgcgaccuucaccaugcggcuccugucccccguccgcgugccgaacuacaaccugaucaucauggacgaggcccacuucaccgaccccgccagcaucgccgcccggggcuacaucuccacgcgcguggagaugggggaggcggccggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggcgggcaacgacaucgccgccugccuccgcaagaacggcaagaaggucauccagcugucccggaagaccuucgacagcgaguacgugaagacccgcgccaacgacugggacuucguggucaccacggacaucuccgagaugggggccaacuucaaggcggagcgggugaucgacccccgccggugcaugaagcccgugauccugaccgacggcgaggagcgcgucauccucgccgggcccaugccggugacccacagcuccgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacccccgagggcaucaucccgagcauguucgagcccgagcgcgagaagguggacgccaucgacggggaguaccggcugcgcggcgaggcccggaagacguucgucgaccugaugcgccgcggggaccuccccguguggcuggccuaccgcguggccgcggagggcaucaacuacgccgaccggcgcuggugcuucgacgggauccggaacaaccagauccuggaggagaacgucgagguggagaucuggaccaaggagggcgagcgcaagaagcucaagccgcgguggcuggacgcccgcaucuacuccgacccccuggcccucaaggaguucaaggaguucgcggccggccggaagucccugacccugaaccucaucaccgagauggggcgccugcccacguucaugacccagaaggcccgggacgcccuggacaaccucgccgugcugcacaccgcggaggccggcgggcgcgccuacaaccacgcccuguccgagcuccccgagacccuggagacgcugcuccugcugacccuccuggccaccgucaccggcggcaucuuccuguuccucaugagcgggaagggcaucgggaagaugacgcugggcaugugcugcaucaucaccgcguccauccugcucugguacgcccagauccagccgcacuggaucgccgccagcaucauccuggaguucuuccugaucgugcuccugauccccgagcccgagaagcagcggacgccccaggacaaccagcugaccuacgucgugaucgccauccucaccguggucgcggccacgauggccaacgagaugggguuccuggagaagaccaagaaggaccugggccucggcagcaucgccacccaggaguccgagagcaacauccuggacaucgaccugcgcccggccuccgcguggacccucuacgccguggccacgaccuucgugacccccaugcugcggcacagcaucgagaacuccagcgucaacgugucccugaccgccaucgcgaaccaggccacggugcucauggggcugggcaagggguggccccugagcaagauggacaucggcgucccccuccuggccaucgggugcuacucccaggugaacccgaucacccugaccgccgcccuccugcugcucguggcgcacuacgccaucaucggccccggccugcaggccaaggccacccgcgaggcccagaagcgcgcggccgccgggaucaugaagaaccccacggucgacggcaucaccgugaucgaccuggagcccaucccguacgaccccaaguucgagaagcagcucggccaggugaugcugcugauccucugcgucacccaggugcugaugaugcggaccacgugggcccugugcgaggcccucacccuggcgaccggccccaucagcacccugugggaggggaaccccggccgcuucuggaacacgaccaucgccguguccauggccaacaucuuccggggcagcuaccucgccggggcgggccugcuguucuccaucaugaagaacaccaccaacacgcgccgggggaccggcaacaucggcgagacccucggggagaaguggaagucccgccugaacgcccugggcaaguccgaguuccagaucuacaagaaguccgggauccaggaggucgaccggacccucgccaaggagggcaucaagcgcggggagacggaccaccacgccgugucccggggcagcgccaagcugcgcugguucguggagcggaacauggucaccccggagggcaaggugguggaccuggggugcggccgcgggggcugguccuacuacugcgggggccucaagaacguccgggaggugaagggccugaccaagggcgggcccgggcacgaggagcccauccccaugagcaccuacggcuggaaccuggugcgccuccagagcggggucgacguguucuucacgccgcccgagaagugcgacacccugcugugcgacaucggcgaguccagccccaaccccaccaucgaggcgggccggacccuccgcgugcugaaccuggucgagaacuggcucaacaacaacacgcaguucugcaucaaggugcugaacccguacaugcccuccgugaucgagaagauggagacccugcagcggaaguacgggggcgcccugguccgcaacccccucagccggaacuccacccacgagauguacugggugagcaacgccaccgggaacaucguguccagcgucaacaugaucucccgcaugcugaucaaccgcuucaccaugaagcacaagaaggccacguacgagccggacguggaccugggcagcgggacccggaacaucggcaucgaguccgagauccccaaccucgacaucaucggcaagcgcaucgagaagaucaagcaggagcacgagaccagcuggcacuacgaccaggaccaccccuacaagaccugggccuaccacggguccuacgagacgaagcagaccggcagcgcguccagcauggugaacggggucgugcggcugcugaccaagcccugggacguggucccgauggugacccagauggccaugacggacaccacccccuucggccagcagcgcguguucaaggagaaggucgacacccggacgcaggagcccaaggagggcaccaagaagcucaugaagaucaccgccgaguggcuguggaaggagcuggggaagaagaagacgccccggaugugcacgcgggaggaguucacccgcaaggugcgguccaacgccgcccucggcgcgaucuucaccgacgagaacaaguggaaguccgcccgcgaggccguggaggacucccgguucugggagcugaucgaccgcgagcggaaccugcaccucgaggggaagugcgagaccugcgucuacaacaugaugggcaagcgcgagaagaagcugggggaguucggcaaggccaagggcagccgggcgaucugguacauguggcugggggcccgcuuccucgaguucgaggcccugggcuuccugaacgaggaccacugguucagccgggggaacucccucagcggcguggagggggagggccugcaccgccugggcuacauccuccgggacguguccaagaaggagggcggggccauguacgccgacgacacggcggggugggacacccgcaucacccuggaggaccugaagaacgaggagauggucaccaaccacaugaagggcgagcacaagaagcucgccgaggccaucuucaagcugacguaccagaacaaggugguccgggugcagcgcccgacgccccgcgggaccgugauggacaucaucagccggcgcgaccagcggggcuccggccaggucgggaccuacggccugaacacguucaccaacauggaggcccagcucauccgccagauggagggggagggcaucuucaagagcauccagcaccugaccgugaccgaggagaucgccgugcagaacuggcuggcgcgggucggccgcgagcggcucucccgcauggccaucagcggggacgacugcguggugaagccccuggacgaccgguucgccuccgcccugacggcccucaacgacaugggcaagguccgcaaggacauccagcagugggagcccagccggggguggaacgacuggacccaggugccguucugcucccaccacuuccacgagcuggugaugaaggacggccgcguccugguggugcccugccggaaccaggacgagcucaucgggcgcgcgcggaucagccagggcgccggcuggucccugaaggagaccgccugccugggcaagagcuacgcccagauguggacccucauguacuuccaccgccgggaccugcgccuggccgcgaacgccaucugcuccgccguccccagccacugggugcccacgucccggaccaccuggagcauccacgccaagcacgaguggaugaccaccgaggacaugcucgcgguguggaaccgcgucuggauccaggagaacccguggauggaggacaagacgcccguggagagcugggaggaggugcccuaccugggcaagcgcgaggaccaguggugcgggucccugaucggccucaccagccgggccaccugggccaagaacauccagaccgccaucaaccagguccgcucccugaucgggaacgaggaguacacggacuacaugcccagcaugaagcgguuccgccgggaggaggaggaggccggcgugcugugguga

SEQ ID NO: 9748 - RNA, 9876 nt, Artificial Sequence
  derived and/or modified CDS sequence (opt1) from DENV-2__GQ398301__SS-prME
accgccggggugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucgcggagaaggacagccccgugaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcgcugcaccagguguucggcgccaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggcgaugguccaggccgacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggcgggcaagcggucccugcgcccgcagcccaccgagcucaaguacagcuggaagaccuggggcaaggccaagaugcuguccaccgagagccacaaccagacguuccugaucgacgggcccgagaccgccgagugcccgaacaccaaccgggccuggaacucccucgaggucgaggacuacggcuucgggguguucaccacgaacaucuggcugaagcugcgcgagaagcaggacguguucugcgacagcaagcucauguccgccgcgaucaaggacaaccgggccguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgcggggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgccuccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccaugcuccugguggccgccuccuucgucacccugaucacggggaacaugagcuuccgggaccucggccgcgugauggugauggucggggccaccaugaccgacgacaucggcaugggcaucaccuaccuggcgcugcucgccgccuucaaggugcgccccacguucgccgccgggcugcugcuccggaagcugaccuccaaggagcugaugauggcgaccaucggcaucgcccuccugagccaguccaccauccccgagacgauccuggagcucaccgacgcccuggcccuggggaugauggugcucaagaucguccgcaacauggagaaguaccagcuggccgugaccaucauggcgaucagcugcgugccgaacgccgucauccugcagaacgccuggaagguguccugcaccauccucgccgcggugagcgucagcccccugcugcucacgagcucccagcagaaggccgacuggaucccccuggcccugaccaucaagggccucaaccccaccgccaucuuccugaccacgcugagccggaccuccaagaagcgcagcuggccgcucaacgaggccaucauggcggugggcauggucuccauccuggccagcagccugcucaagaacgacauccccaugaccgggccccugguggccggcgggcugcucaccgugugcuacguccugacgggccgguccgccgaccuggagcucgagcgcgccgcggacgugaagugggaggaccaggccgagaucagcggguccagccccauccuguccaucaccaucagcgaggacggcuccaugagcaucaagaacgaggaggaggagcagacccugaccauccucauccggacgggccugcuggugaucuccggggucuucccggugagcauccccaucaccgccgccgccugguaccucugggaggugaagaagcagcgcgcgggcguccugugggacgugcccagcccgccgcccguggggaaggccgagcuggaggacggcgccuaccggaucaagcagcgcgggauccucggcuacagccagaucggcgccggggucuacaaggagggcaccuuccacaccauguggcacgugacccgcggggcggugcugaugcaccgcggcaagcggaucgagcccuccugggcggacgucaagaaggaccugaucagcuacgggggcggcuggaagcucgagggggaguggaaggagggcgaggagguccaggugcuggcccuggagcccgggaagaacccccgcgccguccagacgaagcccggccucuucaagaccaacaccgggaccaucggcgccgugucccuggacuucagccccggcacguccgggagccccaucguggaccggaagggcaaggucguggggcuguacggcaacggcguggucacccgcuccggggcguacgugagcgccaucgcccagaccgagaaguccaucgaggacaaccccgagaucgaggacgacaucuuccggaagaagcgccucaccaucauggaccugcaccccggcgccgggaagacgaagcgguaccugcccgccaucgugcgcgaggcgaucaagcggggccugcgcacccucauccuggccccgacccgcgucguggccgccgagauggaggaggcccugcgggggcuccccauccgcuaccagacccccgcgauccgggccgagcacacgggccgcgagaucguggaccugaugugccacgccaccuucaccaugcggcugcucucccccguccgcgugccgaacuacaaccugaucaucauggacgaggcccacuucaccgaccccgccagcaucgcggcccggggcuacaucuccacgcgcguggagaugggggaggccgccggcaucuucaugaccgcgacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgccgccugccugcgcaagaacggcaagaaggucauccagcucucccggaagaccuucgacagcgaguacgugaagacccgcgcgaacgacugggacuucguggucaccacggacaucuccgagaugggggccaacuucaaggccgagcgggugaucgacccccgccggugcaugaagcccgugauccugaccgacggcgaggagcgcgucauccuggccgggcccaugccggugacccacagcuccgccgcgcagcggcgcggccgcaucgggcggaaccccaagaacgagaacgaccaguacaucuacaugggcgagccccucgagaacgacgaggacugcgcccacuggaaggaggccaagaugcugcuggacaacaucaacacccccgagggcaucaucccgagcauguucgagcccgagcgcgagaagguggacgccaucgacggggaguaccggcuccgcggcgaggcccggaagacguucgucgaccugaugcgccgcggggaccugcccguguggcucgcguaccgcguggccgccgagggcaucaacuacgccgaccggcgcuggugcuucgacgggaucaagaacaaccagauccuggaggagaacgucgagguggagaucuggaccaaggagggcgagcggaagaagcugaagccgcgcuggcucgacgcgcggaucuacuccgacccccuggcccugaaggaguucaaggaguucgccgccggccgcaagagccucacccugaaccugaucaccgagauggggcggcuccccacguucaugacccagaaggcccgcgacgcgcuggacaaccuggccgugcuccacaccgccgaggccggcgggcgggccuacaaccacgcgcuguccgagcugcccgagacccucgagacgcugcugcuccugacccugcucgccaccgucaccggcggcaucuuccuguuccugaugagcgggaagggcaucgggaagaugacgcucggcaugugcugcaucaucaccgccuccauccugcugugguacgcccagauccagccgcacuggaucgccgcgagcaucauccucgaguucuuccugaucgugcugcucauccccgagcccgagaagcagcgcacgccccaggacaaccagcugaccuacgucgugaucgccauccugaccguggucgccgccacgauggccaacgagaugggguuccucgagaagaccaagaaggaccugggccugggcagcaucgcgacccaggaguccgagagcaacauccucgacaucgaccugcggccggccuccgccuggacccuguacgccguggcgacgaccuucgugacccccaugcuccgccacagcaucgagaacuccagcgucaacgugucccugaccgccaucgccaaccaggccacggugcugauggggcucggcaagggguggccccugagcaagauggacaucggcgucccccugcucgccaucgggugcuacucccaggugaacccgaucacccugaccgcggcccugcuccugcugguggcccacuacgccaucaucggccccggccuccaggccaaggcgacccgggaggcccagaagcgcgccgccgccgggaucaugaagaaccccacggucgacggcaucaccgugaucgaccuggagcccaucccguacgaccccaaguucgagaagcagcugggccaggugaugcuccugauccugugcgucacccaggugcucaugaugcgcaccacgugggcgcugugcgaggcccugacccucgccaccggccccaucagcacccugugggaggggaaccccggccgguucuggaacacgaccaucgccguguccauggcgaacaucuuccgcggcagcuaccuggccggggccggccuccuguucuccaucaugaagaacaccaccaacacgcggcgcgggaccggcaacaucggcgagacccugggggagaaguggaagucccggcucaacgcccugggcaaguccgaguuccagaucuacaagaaguccgggauccaggaggucgaccgcacccuggccaaggagggcaucaagcgcggggagacggaccaccacgcggugucccgcggcagcgccaagcuccggugguucguggagcgcaacauggucaccccggagggcaaggugguggaccuggggugcggccgcggcgggugguccuacuacugcggcgggcugaagaacguccgcgaggugaaggggcucaccaagggcgggcccgggcacgaggagcccauccccaugagcaccuacggcuggaaccuggugcggcugcagagcggggucgacguguucuucacgccgcccgagaagugcgacacccuccugugcgacaucggcgaguccagccccaaccccaccaucgaggccggccgcacccugcgggugcucaaccuggucgagaacuggcugaacaacaacacgcaguucugcaucaaggugcucaacccguacaugcccuccgugaucgagaagauggagacccugcagcgcaaguacgggggcgcccugguccggaacccccugagccgcaacuccacccacgagauguacugggugagcaacgccaccgggaacaucguguccagcgucaacaugaucucccggaugcucaucaaccgcuucaccaugaagcacaagaaggcgacguacgagccggacguggaccugggcagcgggacccgcaacaucggcaucgaguccgagauccccaaccuggacaucaucggcaagcggaucgagaagaucaagcaggagcacgagaccagcuggcacuacgaccaggaccaccccuacaagaccugggccuaccacggguccuacgagacgaagcagaccggcagcgccuccagcauggugaacggggucgugcgccuccugaccaagcccugggacguggucccgauggugacccagauggccaugacggacaccacccccuucggccagcagcggguguucaaggagaaggucgacacccgcacgcaggagcccaaggagggcaccaagaagcugaugaagaucaccgccgaguggcucuggaaggagcuggggaaggagaagacgccccggaugugcacgcgcgaggaguucacccggaaggugcgcuccaacgcggcccugggcgccaucuucaccgacgagaacaaguggaaguccgcccgggaggcgguggaggacucccgcuucugggagcucaucgaccgggagcgcaaccugcaccuggaggggaagugcgagaccugcgucuacaacaugaugggcaagcgggagaagaagcucggggaguucggcaaggccaagggcagccgcgccaucugguacauguggcugggggcccgguuccuggaguucgaggcccucggcuuccugaacgaggaccacugguucagccgcgggaacucccugagcggcguggagggggagggccuccaccggcugggcuacauccugcgcgacguguccaagaaggagggcggggcgauguacgccgacgacacggccgggugggacacccggaucacccucgaggaccugaagaacgaggagauggucaccaaccacaugaagggcgagcacaagaagcuggccgaggccaucuucaagcucacguaccagaacaaggugguccgcgugcagcggccgacgccccgggggaccgugauggacaucaucagccgccgggaccagcgcggcuccggccaggucgggaccuacggccugaacacguucaccaacauggaggcgcagcugauccggcagauggagggggagggcaucuucaagagcauccagcaccucaccgugaccgaggagaucgccgugcagaacuggcuggcccgcgucggccgggagcgccugucccggauggccaucagcggggacgacugcguggugaagccccucgacgaccgcuucgccuccgcgcugacggcccugaacgacaugggcaagguccggaaggacauccagcagugggagcccagccgcggguggaacgacuggacccaggugccguucugcucccaccacuuccacgagcucgugaugaaggacggccggguccugguggugcccugccgcaaccaggacgagcugaucgggcgggcccgcaucagccagggcgccggcuggucccucaaggagaccgccugccugggcaagagcuacgcgcagauguggacccugauguacuuccaccggcgcgaccuccggcuggccgccaacgccaucugcuccgcgguccccagccacugggugcccacgucccgcaccaccuggagcauccacgccaagcacgaguggaugaccaccgaggacaugcuggccguguggaaccgggucuggauccaggagaacccguggauggaggacaagacgcccguggagagcugggaggaggugcccuaccucggcaagcgcgaggaccaguggugcgggucccugaucggccugaccagccgcgccaccugggccaagaacauccagaccgcgaucaaccagguccggucccucaucgggaacgaggaguacacggacuacaugcccagcaugaagcgcuuccggcgcgaggaggaggaggccggcgugcugugguga

SEQ ID NO: 9749 - RNA, 9876 nt, Artificial Sequence
  derived and/or modified CDS sequence (opt1) from DENV-2__GQ398312__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacuccaccagcaccugggugaccuacgggaccugcaccaccacgggcgagcaccggcgcgagaagcgguccgucgcccuggugccccacguggggaugggccucgagacccggaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucgcggagaaggacagccccgugaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcgcugcaccagguguucggcgccaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggcgaugguccaggccgacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggcgggcaagcggucccugcgcccgcagcccaccgagcucaaguacagcuggaagaccuggggcaaggccaagaugcuguccaccgagagccacaaccagacguuccugaucgacgggcccgagaccgccgagugcccgaacaccaaccgggccuggaacucccucgaggucgaggacuacggcuucgggguguucagcaccaacaucuggcugaagcugcgcgagaagcaggacguguucugcgacuccaagcucaugagcgccgcgaucaaggacaaccgggccguccacgccgacaugggcuacuggaucgaguccgcccugaacgacacguggaagauggagaaggccagcuucaucgaggugaaguccugccacuggcccaagagccacacccugugguccaacggcgugcucgagagcgagaugaucauccccaagaacuucgcggggcccgucagccagcacaacuaccgcccgggcuaccacacccagaccgccgggcccuggcaccugggcaagcuggagauggacuucgacuucugcgaggggaccacggugguggucaccgaggacugcggcaaccggggccccucccuccgcaccaccacggccagcgggaagcugaucaccgaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacgcgcgugggcaccaagcacgccaugcuccugguggccgucagcuucgugacccugaucaccgggaacauguccuuccgggaccucggccgcgugauggucauggugggggccacgaugaccgacgacaucggcaugggcaucaccuaccuggcccugcucgcggccuucaaggugcgccccaccuucgccgccgggcugcugcuccggaagcugacgagcaaggagcugaugauggccaccaucggcaucgcgcuccugucccagagcaccauccccgagaccauccuggagcucacggacgcccuggcccuggggaugaugguccucaagaucgugcgcaacauggagaaguaccagcuggccgugaccaucauggccaucuccugcgucccgaacgcggugauccugcagaacgccuggaaggugagcugcaccauccucgccgccgucuccgugagcccccugcugcucaccuccagccagcagaaggcggacuggaucccccuggcccugacgaucaagggccucaaccccaccgccaucuuccugaccacccugucccggacgagcaagaagcgcuccuggccgcucaacgaggccaucauggccgucggcauggugagcauccuggcgagcucccugcucaagaacgacauccccaugaccgggccccugguggccggcgggcugcucaccgucugcuacgugcugaccggccggagcgccgaccuggagcucgagcgcgccgccgacgugaagugggaggaccaggcggagaucuccgggagcucccccauccugagcaucacgaucuccgaggacggcagcauguccaucaagaacgaggaggaggagcagacccugaccauccucauccggaccggccugcuggucaucagcgggguguucccgguguccauccccaucacggccgccgccugguaccucugggaggucaagaagcagcgcgccggcgugcugugggacgugcccagcccgccgcccgucgggaaggcggagcuggaggacggcgccuaccggaucaagcagcgcgggauccucggcuacucccagaucggcgccgggguguacaaggagggcaccuuccacaccauguggcacgugacccgcggggcgguccugaugcaccgcggcaagcggaucgagcccagcugggccgacgugaagaaggaccugaucuccuacgggggcggcuggaagcucgagggggaguggaaggagggcgaggaggugcagguccuggcgcuggagcccgggaagaacccccgcgccgugcagaccaagcccggccucuucaagacgaacaccgggaccaucggcgccgugagccuggacuucucccccggcaccagcgggucccccaucgucgaccggaagggcaaggugguggggcuguacggcaacggcgucgugacgcgcagcggggccuacgugagcgcgaucgcccagaccgagaaguccaucgaggacaaccccgagaucgaggacgacaucuuccggaagaagcgccucaccaucauggaccugcaccccggcgccgggaagaccaagcgguaccugcccgccaucguccgcgaggccaucaagcggggccugcgcacgcucauccuggcgccgacccgcgugguggccgccgagauggaggaggcccugcgggggcuccccauccgcuaccagacccccgccauccgggcggagcacaccggccgcgagaucgucgaccugaugugccacgccacguucaccaugcggcugcucagccccgugcgcgugccgaacuacaaccugaucaucauggacgaggcccacuucaccgaccccgccuccaucgccgcgcggggcuacaucagcacccgcgucgagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgugugguucgucccguccaucaaggccggcaacgacaucgccgccugccugcgcaagaacggcaagaaggugauccagcucagccggaagacguucgacuccgaguacgugaagacccgcgccaacgacugggacuucgucgugaccaccgacaucagcgagaugggggcgaacuucaaggccgagcgggugaucgacccccgccggugcaugaagcccgucauccugacggacggcgaggagcgcgugauccuggccgggcccaugccggugacccacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaaggucgacgccaucgacggggaguaccggcuccgcggcgaggcccggaagaccuucguggaccugaugcgccgcggggaccugcccguguggcucgccuaccgcgucgcggccgagggcaucaacuacgccgaccggcgcuggugcuucgacgggaucaagaacaaccagauccuggaggagaacguggagguggagaucuggacgaaggagggcgagcggaagaagcugaagccgcgcuggcucgacgcccggaucuacagcgacccccuggcgcugaaggaguucaaggaguucgccgccggccgcaagucccucacccugaaccugaucaccgagauggggcggcuccccaccuucaugacgcagaaggcccgcgacgcccuggacaaccuggcgguccuccacaccgccgaggccggcgggcgggccuacaaccacgcccugagcgagcugcccgagacccucgagacccugcugcuccugacgcugcucgcgaccgugaccggcggcaucuuccuguuccugauguccgggaagggcaucgggaagaugacccucggcaugugcugcaucaucacggccagcauccugcugugguacgcccagauccagccgcacuggaucgccgccagcaucauccucgaguucuuccugaucguccugcucauccccgagcccgagaagcagcgcacgccccaggacaaccagcugaccuacguggugaucgcgauccugaccgucguggccgccaccauggccaacgagaugggguuccucgagaagacgaagaaggaccugggccugggcuccaucgccacccaggagagcgaguccaacauccucgacaucgaccugcggccggcgagcgccuggacccuguacgccguggccaccacguucgucacccccaugcuccgccacuccaucgagaacagcuccgugaacgugagccugaccgcgaucgccaaccaggccaccguccugauggggcucggcaagggguggccccuguccaagauggacaucggcgugccccugcucgccaucgggugcuacagccaggugaacccgaucacgcugaucgccgcgcugcuccugcuggucgcccacuacgccaucaucggccccggccuccaggccaaggccacccgggaggcgcagaagcgcgccgccgccgggaucaugaagaaccccaccguggacggcaucaccgugaucgaccuggagcccaucccguacgaccccaaguucgagaagcagcuggggcaggucaugcuccugauccugugcgugacccagguccucaugaugcgcaccaccugggcccugugcgaggcgcugacccucgccacgggccccaucuccacccugugggaggggaaccccggccgguucuggaacaccaccaucgccgucagcauggccaacaucuuccgcggcuccuaccuggcgggggccggccuccuguucagcaucaugaagaacacgaccaacacccggcgcgggaccggcaacaucggcgagacgcugggggagaaguggaagucccggcucaacgcccugggcaagagcgaguuccagaucuacaagaaguccgggauccaggagguggaccgcacccuggccaaggagggcaucaagcgcggggagaccgaccaccacgccgugagccgcggcuccgcgaagcuccggugguucgucgagcgcaacauggugaccccggagggcaagguggucgaccuggggugcggccgcggcggguggagcuacuacugcggcgggcugaagaacgugcgcgaggugaaggggcucacgaagggcgggcccgggcacgaggagcccauccccaugagcaccuacggcuggaaccugguccggcugcaguccgggguggacguguucuucaccccgcccgagaagugcgacacccuccugugcgacaucggcgagagcucccccaaccccacgaucgaggccggccgcacccugcggguccucaaccugguggagaacuggcugaacaacaacacccaguucugcaucaaggugcucaacccguacaugcccagcgucaucgagaagauggagacccugcagcgcaaguacgggggcgcccuggugcggaacccccugucccgcaacagcacgcacgagauguacuggguguccaacgccaccgggaacaucgucagcuccgugaacaugaucagccggaugcucaucaaccgcuucaccaugaagcacaagaaggccaccuacgagccggacguggaccugggcuccgggacccgcaacaucggcaucgagagcgagauccccaaccuggacaucaucggcaagcggaucgagaagaucaagcaggagcacgagacguccuggcacuacgaccaggaccaccccuacaagaccugggcguaccacgggagcuacgagaccaagcagaccggcuccgccagcuccauggucaacgggguggugcgccuccugacgaagcccugggacgucgugccgauggugacccagauggccaugaccgacaccacgcccuucggccagcagcgggucuucaaggagaagguggacacccgcacccaggagcccaaggagggcaccaagaagcugaugaagaucacggccgaguggcucuggaaggagcuggggaagaagaagacgccccggaugugcacccgcgaggaguucacccggaaggugcgcagcaacgccgcgcugggcgccaucuucacggacgagaacaaguggaaguccgcccgggaggccgucgaggacagccgcuucugggagcucaucgaccgggagcgcaaccugcaccuggaggggaagugcgagaccugcguguacaacaugaugggcaagcgggagaagaagcucggggaguucggcaaggcgaagggcagccgcgccaucugguacauguggcugggggcccgguuccuggaguucgaggcccucggcuuccugaacgaggaccacugguucucccgcgggaacagccuguccggcguggagggggagggccuccaccggcugggcuacauccugcgcgacgucagcaagaaggagggcggcgccauguacgcggacgacaccgccgggugggacacccggaucacgcucgaggaccugaagaacgaggagauggugaccaaccacaugaagggcgagcacaagaagcuggccgaggccaucuucaagcucaccuaccagaacaaggucgugcgcgugcagcggccgacgccccgggggacggucauggacaucaucucccgccgggaccagcgcggcagcggccagguggggaccuacggccugaacaccuucaccaacauggaggcccagcugauccggcagauggagggggagggcaucuucaaguccauccagcaccucacggugaccgaggagaucgcgguccagaacuggcuggcccgcgugggccgggagcgccugagccggauggccaucuccggggacgacugcguggucaagccccucgacgaccgcuucgccagcgcccugaccgcgcugaacgacaugggcaaggugcggaaggacauccagcagugggagcccucccgcggguggaacgacuggacccaggugccguucugcagccaccacuuccacgagcucgucaugaaggacggccgggugcuggugguccccugccgcaaccaggacgagcugaucgggcgggcccgcaucucccagggcgccggcuggagccucaaggagacggccugccuggggaaguccuacgcccagauguggacccugauguacuuccaccggcgcgaccuccggcuggcggccaacgccaucugcagcgccgugcccucccacugggugcccaccagccgcaccacguggagcauccacgcgaagcacgaguggaugaccaccgaggacaugcuggccgucuggaaccggguguggauccaggagaacccguggauggaggacaagacccccguggaguccugggaggagguccccuaccucggcaagcgcgaggaccaguggugcgggagccugaucggccugaccucccgcgccacgugggccaagaacauccagaccgccaucaaccaggugcggagccucaucgggaacgaggaguacaccgacuacaugcccuccaugaagcgcuuccggcgcgaggaggaggaggcgggcgugcugugguga

SEQ ID NO: 9750 - RNA, 9876 nt, Artificial Sequence
  derived and/or modified CDS sequence (opt1) from DENV-2__GQ398289__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagaccuggauccugcgccacccgggcuucgccaucauggcggccauccuggccuacaccaucgggaccacccacuuccagcgggcccucaucuucauccugcugaccgcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucgugugcaagcacuccaugguggaccggggcugggggaacggcugcggccucuucggcaagggcgggaucgucacgugcgccauguucacgugcaagaagaacauggagggcaagguggugcugcccgagaaccuggaguacaccaucgucaucacgccccacagcggggaggagcacgccgugggcaacgacacggggaagcacggcaaggagaucaagaucaccccgcaguccagcaucaccgaggccgagcucaccggguacggcaccgugacgauggagugcagcccccggaccggccuggacuucaacgagaugguccugcuccagauggaggacaaggccuggcuggugcaccggcagugguuccuggaccucccccugcccuggcugccgggggcggacacccagggcagcaacuggauccagaaggagacccucgugacguucaagaacccccacgccaagaagcaggacgucgugguccuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgugaaggagaucgcggagacccagcacgggaccaucgugauccgcguccaguacgagggcgacggcucccccugcaagauccccuucgagaucauggaccucgagaagcggcacgugcuggggcgccugaucacggugaacccgaucgucaccgagaaggacagccccgugaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcgcugcaccagguguucggcgccaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggcgaugguccaggccgacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaccaaggggaucaugcaggcgggcaagcggucccugcgcccgcagcccaccgagcucaaguacagcuggaagaccuggggcaaggccaagaugcuguccacggagagccacaaccagaccuuccugaucgacgggcccgagaccgccgagugcccgaacaccaaccgggccuggaacucccucgaggucgaggacuacggcuucgggguguucacgaccaacaucuggcugaagcugcgcgagaagcaggacguguucugcgacagcaagcucauguccgccgcgaucaaggacaaccgggccguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgcggggcccgugagccagcacaacuaccgcccgggcuaccacacccagacggccgggcccuggcaccugggcaagcuggagauggacuucgacuucugcgaggggaccaccgugguggucaccgaggacugcggcaaccggggccccagccuccgcacgaccaccgccuccgggaagcugaucaccgaguggugcugccggagcugcacgcugcccccgcuccgcuaccggggcgaggacgggugcugguacggcauggagauccgcccccugaaggagaaggaggagaaccuggugaacucccucgugaccgccgggcacggccagaucgacaacuucagccugggcguccuggggauggcccucuuccuggaggagaugcugcggacccgcgugggcaccaagcacgccauccuccugaucgccguguccuucgucacgcugaucaccgggaacaugagcuuccgggaccucggccgcgugauggugauggucggggccaccaugaccgacgacaucggcaugggcgugacguaccuggcccugcucgcggccuucaaggugcgccccaccuucgccgccgggcugcugcuccggaagcugaccuccaaggagcugaugauggccaccaucggcaucgcgcuccugagccaguccacgauccccgagaccauccuggagcucaccgacgcccuggcccuggggaugaugguccucaagaucgugcgcaacauggagaaguaccagcuggccgugaccaucauggccaucagcugcgucccgaacgcggugauccugcagaacgccuggaagguguccugcacgauccucgccgccgucagcgugagcccccugcugcucaccagcucccagcagaaggcggacuggaucccccuggcccugaccaucaagggccucaaccccaccgccaucuuccugacgacccugagccggaccuccaagaagcgcagcuggccgcucaacgaggccaucauggccgucggcaugguguccauccuggcgagcagccugcucaagaacgacauccccaugaccgggccccugguggccggcgggcugcucacggucugcuacgugcugaccggccgguccgccgaccuggagcucgagcgcgccgccgacgugaagugggaggaccaggcggagaucagcggguccagccccauccuguccaucaccaucagcgaggacggcuccaugagcaucaagaacgaggaggaggagcagacccugacgauccucauccggaccggccugcuggucaucuccgggguguucccggugagcauccccaucaccgccgccgccugguaccucugggaggucaagaagcagcgcgccggcgugcugugggacgugcccagcccgccgcccgucgggaaggcggagcuggaggacggcgccuaccggaucaagcagcgcgggauccucggcuacagccagaucggcgccgggguguacaaggagggcaccuuccacaccauguggcacgugacgcgcggggcgguccugaugcaccgcggcaagcggaucgagcccuccugggccgacgugaagaaggaccugaucagcuacgggggcggcuggaagcucgagggggaguggaaggagggcgaggaggugcagguccuggcgcuggagcccgggaagaacccccgcgccgugcagaccaagcccggccucuucaagaccaacaccgggacgaucggcgccgugucccuggacuucagccccggcaccuccgggagccccaucgucgaccggaagggcaaggugguggggcuguacggcaacggcgucgugacccgcuccggggccuacgugagcgcgaucgcccagaccgagaaguccaucgaggacaaccccgagaucgaggacgacaucuuccggaagaagcgccucacgaucauggaccugcaccccggcgccgggaagaccaagcgguaccugcccgccaucguccgcgaggccaucaagcggggccugcgcacccucauccuggcgccgacccgcgugguggccgccgagauggaggaggcccugcgggggcuccccauccgcuaccagacgcccgccauccgggcggagcacaccggccgcgagaucgucgaccugaugugccacgccaccuucaccaugcggcugcucucccccgugcgcgugccgaacuacaaccugaucaucauggacgaggcccacuucacggaccccgccagcaucgccgcgcggggcuacaucuccacccgcgucgagaugggggaggccgccggcaucuucaugaccgccacgccgcccgggagccgggacccguucccccaguccaacgcgcccaucauggacgaggagcgcgagauccccgagcggagcuggaacuccggccacgagugggugacggacuucaaggggaagaccgugugguucgucccgagcaucaaggccggcaacgacaucgccgccugccugcgcaagaacggcaagaaggugauccagcucucccggaagaccuucgacagcgaguacgugaagacccgcgccaacgacugggacuucgucgugacgaccgacaucuccgagaugggggcgaacuucaaggccgagcgggugaucgacccccgccggugcaugaagcccgucauccugaccgacggcgaggagcgcgugauccuggccgggcccaugccggugacccacagcuccgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacgcccgagggcaucaucccgagccucuucgagcccgagcgcgagaaggucgacgccaucgacggggaguaccggcugcgcggcgaggcccggaagaccuucguggaccugaugcgccgcggggaccuccccguguggcuggccuaccgcgucgcggccgagggcaucaacuacgccgaccggcgcuggugcuucgacgggaucaagaacaaccagauccuggaggagaacguggagguggagaucuggaccaaggagggcgagcggaagaagcucaagccgcgcuggcuggacgcccggaucuacuccgacccccuggcgcucaaggaguucaaggaguucgccgccggccgcaagagccugacccugaaccucaucacggagauggggcggcugcccaccuucaugacccagaaggcccgcgacgcccuggacaaccucgcgguccugcacaccgccgaggccggcgggcgggccuacaaccacgcccuguccgagcuccccgagacgcuggagacccugcuccugcugacccuccuggcgaccgugacgggcggcaucuuccuguuccucaugagcgggcgcggcaucgggaagaugacccugggcaugugcugcaucaucaccgccuccauccugcucugguacgcccagauccagccgcacuggaucgccgccagcaucauccuggaguucuuccugaucguccuccugauccccgagcccgagaagcagcggacgccccaggacaaccagcugaccuacguggugaucgcgauccucacggucguggccgccaccauggccaacgagaugggguuccuggagaagaccaagaaggaccugggccucggcagcaucaccacgcaggaguccgagagcaacauccuggacaucgaccugcgcccggccuccgcguggacccucuacgccguggccaccaccuucgucacgcccaugcugcggcacagcaucgagaacuccagcgugaacgugucccugaccgccaucgcgaaccaggccaccguccucauggggcugggcaagggguggccccugagcaagauggacaucggcgugccccuccuggccaucgggugcuacucccaggugaacccgaucacccugacggccgcccuccugcugcucgucgcgcacuacgccaucaucggccccggccugcaggccaaggccacccgcgaggcccagaagcgcgcggccgccgggaucaugaagaaccccaccguggacggcaucaccgugaucgaccuggagcccaucccguacgaccccaaguucgagaagcagcucgggcaggucaugcugcugauccucugcgugacccaggugcugaugaugcggaccaccugggcccugugcgaggcccucacccuggcgacgggccccaucagcacccugugggaggggaaccccggccgcuucuggaacaccaccaucgccgucuccauggccaacaucuuccggggcagcuaccucgccggggcgggccugcuguucuccaucaugaagaacacgaccaacacccgccgggggaccggcaacaucggcgagacgcucggggagaaguggaagucccgccugaacgcccugggcaaguccgaguuccagaucuacaagaaguccgggauccaggagguggaccggacccucgccaaggagggcaucaagcgcggggagaccgaccaccacgccgugucccggggcagcgccaagcugcgcugguucgucgagcggaacauggugaccccggagggcaagguggucgaccuggggugcggccgcgggggcugguccuacuacugcgggggccucaagaacgugcgggaggugaagggccugacgaagggcgggcccgggcacgaggagcccauccccaugagcaccuacggcuggaaccugguccgccuccagagcgggguggacguguucuucaccccgcccgagaagugcgacacccugcugugcgacaucggcgaguccagccccaaccccacgaucgaggcgggccggacccuccgcguccugaaccugguggagaacuggcucaacaacaacacccaguucugcaucaaggugcugaacccguacaugcccuccgucaucgagaagauggagacccugcagcggaaguacgggggcgcccuggugcgcaacccccucagccggaacuccacccacgagauguacugggugagcaacgccacggggaacaucgucuccagcgugaacaugaucucccgcaugcugaucaaccgcuucaccaugaagcacaagaaggccaccuacgagccggacguggaccugggcagcgggacccggaacaucggcaucgaguccgagauccccaaccucgacaucaucggcaagcgcaucgagaagaucaagcaggagcacgagacgagcuggcacuacgaccaggaccaccccuacaagaccugggccuaccacggguccuacgagaccaagcagaccggcagcgcguccagcauggucaacgggguggugcggcugcugacgaagcccugggacgucgugccgauggugacccagauggccaugaccgacaccacgcccuucggccagcagcgcgucuucaaggagaagguggacacccggacccaggagcccaaggagggcaccaagaagcucaugaagaucacggccgaguggcuguggaaggagcuggggaagaagaagacgccccggaugugcacccgggaggaguucacccgcaaggugcgguccaacgccgcccucggcgcgaucuucacggacgagaacaaguggaaguccgcccgcgaggccgucgaggacucccgguucugggagcugaucgaccgcgagcggaaccugcaccucgaggggaagugcgagaccugcguguacaacaugaugggcaagcgcgagaagaagcugggggaguucggcaaggccaagggcagccgggcgaucugguacauguggcugggggcccgcuuccucgaguucgaggcccugggcuuccugaacgaggaccacugguucagccggcgcaacucccucagcgggguggagggcgaggggcugcaccggcugggcuacauccuccgcgacgucuccaagaaggagggcggggccauguacgccgacgacaccgcgggcugggacacccggaucacgcuggaggaccugaagaacgaggagauggugaccaaccacaugaagggggagcacaagaagcucgccgaggccaucuucaagcugaccuaccagaacaaggucgugcgcgugcagcgcccgacgccccggggcacggucauggacaucaucagccgccgggaccagcgcggguccggccaggugggcaccuacgggcugaacaccuucaccaacauggaggcccagcucauccggcagauggagggcgaggggaucuucaagagcauccagcaccugacggugaccgaggagaucgccguccagaacuggcuggcgcgcgugggccgggagcgccucucccggauggccaucagcggcgacgacugcguggucaagccccuggacgaccgcuucgccuccgcccugaccgcccucaacgacauggggaaggugcggaaggacauccagcagugggagcccagccgcggcuggaacgacuggacccaggugccguucugcucccaccacuuccacgagcuggucaugaaggacgggcgggugcuggugguccccugccgcaaccaggacgagcucaucggccgggcgcgcaucagccagggggccggcuggucccugaaggagacggccugccugggcaagagcuacgcccagauguggacccucauguacuuccaccggcgcgaccugcggcuggccgcgaacgccaucugcuccgccgugcccagccacugggugcccaccucccgcaccaccuggagcauccacgccaagcacgaguggaugacgaccgaggacaugcucgcggucuggaaccgcguguggauccaggagaacccguggauggaggacaagacccccguggagagcugggaggagguccccuaccuggggaagcgggaggaccaguggugcggcucccugaucgggcucaccagccgcgccacgugggccaagaacauccagaccgccaucaaccaggugcggucccugaucggcaacgaggaguacaccgacuacaugcccagcaugaagcgcuuccggcgcgaggaggaggaggccggggugcugugguga

SEQ ID NO: 9751 - RNA, 9876 nt, Artificial Sequence
  derived and/or modified CDS sequence (opt1) from DENV-2__GQ398290__SS-prME
accgccggcgugaucaucaugcugauccccaccgccauggcguuccaccucaccacccgcaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcgggcuguucggcaagggcgggaucgugaccugcgcgauguucacgugcaagaagaacauggagggcaagguggugcugcccgagaacuucgaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcggggucuucaccuccaucgggaaggcccuccaccagguguucggggcgaucuacggcgccgccuucagcgggguguccuggaccaugaagauccugaucggcgucaucaucacguggaucgggaugaacagccgcuccaccagccuguccgugagccuggugcucgucggcguggugacccuguaccugggggccaugguccaggcggacuccggcugcguggugagcuggaaguccaaggagcucaagugcggcagcgggaucuucaucaccgacaacguccacacguggaccgagcaguacaaguuccagcccgagagccccuccaagcuggccagcgccauccagaaggcccacgaggagggcaucugcgggauccgguccgugacccgccuggagaaccucauguggaagcagaucacccccgagcugaaccacauccugagcgagaacgaggugaagcucacgaucaugaccggcgacaucaaggggaucaugcaggccggcaagcggucccugcgcccgcagcccaccgagcugaaguacagcuggaagaccuggggcaaggcgaagaugcucuccacggagagccacaaccagaccuuccugaucgacgggcccgagaccgccgagugcccgaacaccaaccgggccuggaacucccuggaggucgaggacuacggcuucgggguguucacgaccaacaucuggcucaagcugcgcgagaagcaggacguguucugcgacagcaagcugauguccgccgccaucaaggacaaccgggcgguccacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccgcccgggcuaccacacccagacggcggggcccuggcaccucggcaagcuggagauggacuucgaccugugcgaggggaccaccgugguggucaccgagaacugcggcaaccggggccccagccuccgcacgaccaccgccuccgggaagcugaucaccgaguggugcugccggagcugcacgcugcccccgcuccgcuaccggggcgaggacgggugcugguacggcauggagauccgcccccugaaggagaaggaggagaaccuggugaacucccucgugaccgccgggcacggccagaucgacaacuucagccugggcguccuggggauggcccucuuccuggaggagaugcugcggacccgcgugggcaccaagcacgcgauccuccugguggccgucuccuucgugacgcugaucaccgggaacaugagcuuccgggaccucggccgcgugauggucauggugggggccaccaugaccgacgacaucggcaugggcgugacguaccuggcccugcucgccgcguucaagguccgccccaccuucgccgccgggcugcugcuccggaagcugaccuccaaggagcugaugauggccaccaucggcaucgcccuccugagccaguccacgauccccgagaccauccuggagcucaccgacgcgcuggcccuggggaugauggugcucaagaucgugcgcaacauggagaaguaccagcuggccgucaccaucauggccaucagcugcgugccgaacgccgugauccugcagaacgcguggaaggucuccugcacgauccucgccgccgugagcgucagcccccugcugcucaccagcucccagcagaaggccgacuggaucccccuggcgcugaccaucaagggccucaaccccaccgccaucuuccugacgacccugagccggaccuccaagaagcgcagcuggccgcucaacgaggccaucauggccgugggcaugguguccauccuggccagcagccugcucaagaacgacauccccaugaccgggccccuggucgcgggcgggcugcucacggugugcuacgugcugaccggccgguccgccgaccuggagcucgagcgcgccgccgacgucaagugggaggaccaggccgagaucagcggguccagccccauccuguccaucaccaucagcgaggacggcuccaugagcaucaagaacgaggaggaggagcagacccugacgauccucauccggaccggccugcuggugaucuccgggguguucccggucagcauccccaucaccgcggccgccugguaccucugggaggugaagaagcagcgcgccggcgugcugugggacguccccagcccgccgcccguggggaaggccgagcuggaggacggcgcguaccggaucaagcagcgcgggauccucggcuacagccagaucggcgccgggguguacaaggagggcaccuuccacaccauguggcacgucacgcgcggggccgugcugaugcaccgcggcaagcggaucgagcccuccugggccgacgugaagaaggaccugaucagcuacgggggcggcuggaagcucgagggggaguggaaggagggcgaggagguccaggugcuggcccuggagcccgggaagaacccccgcgcggugcagaccaagcccggccucuucaagaccaacaccgggacgaucggcgccgucucccuggacuucagccccggcaccuccgggagccccaucguggaccggaagggcaagguggucgggcuguacggcaacggcguggugacccgcuccggggccuacgucagcgccaucgcgcagaccgagaaguccaucgaggacaaccccgagaucgaggacgacaucuuccggaagaagcgccucacgaucauggaccugcaccccggcgccgggaagaccaagcgguaccugcccgccaucgugcgcgaggccaucaagcggggccugcgcacccucauccuggccccgacccgcguggucgcggccgagauggaggaggcccugcgggggcuccccauccgcuaccagacgcccgccauccgggccgagcacaccggccgcgagaucguggaccugaugugccacgcgaccuucaccaugcggcugcucucccccgugcgcgucccgaacuacaaccugaucaucauggacgaggcccacuucacggaccccgccagcaucgccgcccggggcuacaucuccacccgcguggagaugggggaggcggccggcaucuucaugaccgccacgccgcccgggagccgggacccguucccccaguccaacgcccccaucauggacgaggagcgcgagauccccgagcggagcuggaacuccggccacgagugggugacggacuucaaggggaagaccgucugguucgugccgagcaucaaggcgggcaacgacaucgccgccugccugcgcaagaacggcaagaaggugauccagcucucccggaagaccuucgacagcgaguacgucaagacccgcgccaacgacugggacuucguggugacgaccgacaucuccgagaugggggccaacuucaaggcggagcgggucaucgacccccgccggugcaugaagcccgugauccugaccgacggcgaggagcgcgugauccuggccgggcccaugccggucacccacagcuccgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacgcccgagggcaucaucccgagcauguucgagcccgagcgcgagaagguggacgccaucgacggggaguaccggcuccgcggcgaggcccggaagaccuucguggaccugaugcgccgcggggaccugcccgucuggcucgccuaccgcguggccgcggagggcaucaacuacgccgaccggcgcuggugcuucgacgggaucaagaacaaccagauccuggaggagaacguggaggucgagaucuggaccaaggagggcgagcggaagaagcugaagccgcgcuggcucgacgcccggaucuacuccgacccccuggcccugaaggaguucaaggaguucgcggccggccgcaagagccucacccugaaccugaucacggagauggggcggcuccccaccuucaugacccagaaggcccgcgacgcccuggacaaccuggccgugcuccacaccgcggaggccggcgggcgggccuacaaccacgcccuguccgagcugcccgagacgcucgagacccugcugcuccugacccugcucgccaccgucacgggcggcaucuuccuguuccugaugagcgggcgcggcaucgggaagaugacccucggcaugugcugcaucaucaccgcguccauccugcugugguacgcccagauccagccgcacuggaucgccgccagcaucauccucgaguucuuccugaucgugcugcucauccccgagcccgagaagcagcggacgccccaggacaaccagcugaccuacguggucaucgccauccugacggugguggcggccaccauggccaacgagaugggguuccucgagaagaccaagaaggaccugggccugggcagcaucaccacgcaggaguccgagagcaacauccucgacaucgaccugcgcccggccuccgccuggacccuguacgcggucgccaccaccuucgugacgcccaugcuccggcacagcaucgagaacuccagcgugaacgucucccugaccgccaucgccaaccaggcgaccgugcugauggggcucggcaagggguggccccugagcaagauggacaucggcgugccccugcucgccaucgggugcuacucccaggucaacccgaucacccugacggccgcccugcuccugcugguggcccacuacgcgaucaucggccccggccuccaggccaaggccacccgcgaggcccagaagcgcgccgcggccgggaucaugaagaaccccaccguggacggcaucaccgucaucgaccuggagcccaucccguacgaccccaaguucgagaagcagcuggggcaggucaugcuccugauccugugcgugacgcagguccucaugaugcggaccaccugggcccugugcgaggcccugacccucgccacgggccccaucagcacccugugggaggggaaccccggccgcuucuggaacaccaccaucgcgguguccauggccaacaucuuccggggcagcuaccuggccggggccggccuccuguucuccaucaugaagaacacgaccaacacccgccgggggaccggcaacaucggcgagacgcugggggagaaguggaagucccgccucaacacccugggcaaguccgaguuccagaucuacaagaaguccgggauccaggagguggaccggacccuggcgaaggagggcaucaagcgcggggagaccgaccaccacgccgucucccggggcagcgccaagcuccgcugguucguggagcggaacauggugacgccggagggcaaggucguggaccuggggugcggccgcgggggcugguccuacuacugcgggggccugaagaacgugcgggaggucaagggccucaccaagggcgggcccgggcacgaggagcccauccccaugagcaccuacggcuggaaccuggugcgccugcagagcgggguggacgucuucuucaccccgcccgagaagugcgacacgcuccugugcgacaucggcgaguccagccccaaccccaccaucgaggccggccggacccugcgcgugcucaaccugguggagaacuggcugaacaacaacacccaguucugcaucaagguccucaacccguacaugcccuccgugaucgagaagauggagacccugcagcggaaguacgggggcgcccuggugcgcaacccccugagccggaacuccacgcacgagauguacugggucagcaacgcgaccgggaacaucguguccagcgugaacaugaucucccgcaugcucaucaaccgcuucaccaugaagcacaagaaggccaccuacgagccggacgucgaccugggcagcgggacgcggaacaucggcaucgaguccgagauccccaaccuggacaucaucggcaagcgcaucgagaagaucaagcaggagcacgagaccagcuggcacuacgaccaggaccaccccuacaagaccugggccuaccacggguccuacgagaccaagcagacgggcagcgccuccagcauggugaacggggugguccggcuccugaccaagcccugggacguggugccgauggucacccagauggccaugaccgacacgacccccuucggccagcagcgcguguucaaggagaagguggacacccggacccaggagcccaaggagggcacgaagaagcugaugaagaucaccgcggaguggcucuggaaggagcuggggaagaagaagacgccccggaugugcacccgggaggaguucacgcgcaagguccgguccaacgccgcccugggcgccaucuucaccgacgagaacaaguggaaguccgcccgcgaggcgguggaggacucccgguucugggagcucaucgaccgcgagcggaaccugcaccuggaggggaagugcgagaccugcguguacaacaugaugggcaagcgcgagaagaagcucggggaguucggcaaggccaagggcagccgggccaucugguacauguggcugggggcccgcuuccuggaguucgaggcgcucggcuuccugaacgaggaccacugguucagccgggggaacucccugagcggcgucgagggggagggccuccaccgccugggcuacauccugcgggacguguccaagaaggagggcggcgccauguacgccgacgacaccgccgggugggacacgcgcaucacccucgaggaccugaagaacgaggagauggucaccaaccacaugaagggcgagcacaagaagcuggccgaggcgaucuucaagcucaccuaccagaacaagguggugcggguccagcgcccgacgccccgcgggaccgugauggacaucaucagccggcgcgaccagcggggcuccggccagguggggaccuacggccugaacaccuucacgaacauggaggcccagcugauccgccagauggagggggagggcaucuucaagagcauccagcaccucaccgccaccgaggagaucgccguccagaacuggcuggcccgggugggccgcgagcggcugucccgcauggcgaucagcggggacgacugcguggucaagccccucgacgaccgguucgccuccgcccugaccgcccugaacgacaugggcaaggugcgcaaggacauccagcagugggagcccagccggggguggaacgacuggacccaggugccguucugcucccaccacuuccacgagcucgucaugaaggacggccgcgugcuggugguccccugccggaaccaggacgagcugaucgggcgcgcccggaucagccagggcgcgggcuggucccucaaggagaccgccugccugggcaagagcuacgcccagauguggacccugauguacuuccaccgccgggaccuccgccuggccgccaacgcgaucugcuccgccgugcccagccacugggugcccaccucccggaccacguggagcauccacgccaagcacgaguggaugaccaccgaggacaugcuggccgucuggaaccgcguguggauccaggagaacccguggauggaggacaagacccccguggagagcugggaggagguccccuaccucggcaagcgcgaggaccaguggugcgggucccugaucggccugacgagccgggcgaccugggccaagaacauccagaccgccaucaaccaggugcgcucccucaucgggaacgaggaguacaccgacuacaugcccagcaugaagcgguuccgccgggaggaggaggaggccggcgugcugugguga

SEQ ID NO: 9752 - RNA, 9876 nt, Artificial Sequence
  derived and/or modified CDS sequence (opt1) from DENV-2__GQ398284__SS-prME
accgcgggcgugaucaucaugcugauccccaccgccauggcguuccaccucaccacccggaacggggagccccacaugaucgugggcaagcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccgccgggagaagcgcuccgucgcccuggugccccacguggggaugggccucgagacccggaccgagaccuggaugagcuccgagggggccuggaagcacguccagcgcaucgagacguggauccugcggcacccgggcuucaccaucauggccgcgauccuggccuacaccaucgggaccacgcacuuccagcgcgcccucaucuucauccugcugaccgccguggcgcccagcaugaccaugcggugcaucggcaucuccaaccgcgacuucguggagggcgucagcgggggcuccuggguggacaucgugcucgagcacgggagcugcgucaccacgauggccaagaacaagcccacccuggacuucgagcugaucaagaccgaggccaagcagcccgccacccuccggaaguacugcaucgaggccaagcugacgaacaccaccaccgagucccgcugcccgacgcagggcgagcccagccugaacgaggagcaggacaagcgguuccucugcaagcacuccaugguggaccgcggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccgccagugguuccuggaccucccccugcccuggcugccgggggccgacacccagggcagcaacuggauccagaaggagacgcucgugaccuucaagaacccccacgcgaagaagcaggacguggucgcccuggggucccaggagggcgccaugcacaccgcccugaccggggccacggagauccagaugagcagcggcaaccuccuguucaccggccaccugaagugccggcuccgcauggacaagcugcagcugaaggggauguccuacagcaugugcaccggcaaguucaagaucgugaaggagaucgcggagacccagcacgggacgaucgucauccgggugcaguacgagggcgacggcucccccugcaagauccccuucgagaucauggaccucgagaagcgccacgugcuggggcggcugaucaccgucaacccgaucgugaccgagaaggacagccccgugaacaucgaggccgagccgcccuucggcgacuccuacaucaucaucggggucgagccgggccagcucaagcugaacugguucaagaaggggagcuccaucggccagauguucgagaccacgaugcgcggcgccaagcgcauggccauccugggggacaccgccugggacuucggcagccucgggggcguguucaccuccaucgggaaggcgcugcaccagguguucggcgccaucuaccgggccgccuucagcggcgucuccuggaccaugaagauccugaucggggugaucaucacguggaucggcaugaacagccgcuccaccagccuguccgugagccucguccugguggggguggucacccuguaccucggcgcgauggugcaggccgacuccgggugcguggucagcuggaagaacaaggagcugaagugcggcuccggcaucuucaucaccgacaacgugcacacguggaccgagcaguacaaguuccagcccgagagccccagcaagcuggccuccgccauccagaaggcccacgaggaggggaucugcggcauccggagcgugacccgccucgagaaccugauguggaagcagaucacccccgagcugaaccacauccucuccgagaacgaggucaagcugacgaucaugaccggggacaucaagggcaucaugcaggcggggaagcggagccugcgcccgcagcccaccgagcucaaguacuccuggaagaccuggggcaaggccaagaugcugagcacggagucccacaaccagaccuuccugaucgacggccccgagaccgccgagugcccgaacaccaaccgggccuggaacagccucgagguggaggacuacggguucggcguguucacgaccaacaucuggcugaagcugcgcgagaagcaggacgucuucugcgacuccaagcucaugagcgccgcgaucaaggacaaccgggccgugcacgccgacaugggguacuggaucgaguccgcccugaacgacaccuggaagauggagaaggccagcuucaucgaggugaaguccugccacuggcccaagagccacacccugugguccaacggcguccucgagagcgagaugaucauccccaagaacuucgcgggccccgugucccagcacaacuaccgcccgggguaccacacccagacggccggccccuggcaccuggggaagcuggagauggacuucgacuucugcgagggcaccaccguggucgugaccgaggacugcgggaaccggggccccagccuccgcacgaccaccgccagcggcaagcugaucaccgaguggugcugccgguccugcacgcugcccccgcuccgcuaccgcggggaggacggcugcugguacgggauggagauccgcccccugaaggagaaggaggagaaccuggugaacagccucgucaccgccggccacgggcagaucgacaacuucucccugggcgugcugggcauggcccucuuccuggaggagaugcugcggacccgcguggggaccaagcacgccauccuccuggucgccgugagcuucgugacgcugaucaccggcaacauguccuuccgggaccucgggcgcgucauggugauggugggcgccaccaugaccgacgacaucgggaugggcgucacguaccuggcccugcucgcggccuucaaggugcgccccaccuucgccgccggccugcugcuccggaagcugaccagcaaggagcugaugauggccaccaucgggaucgcgcuccugucccagagcacgauccccgagaccauccuggagcucaccgacgcccuggcccugggcaugauggugcucaagaucguccgcaacauggagaaguaccagcuggccgugaccaucauggccaucuccugcgugccgaacgcggucauccugcagaacgccuggaaggugagcugcacgauccucgccgccguguccgucagcccccugcugcucaccuccagccagcagaaggcggacuggaucccccuggcccugaccaucaaggggcucaaccccaccgccaucuuccugacgacccugucccggaccagcaagaagcgcuccuggccgcucaacgaggccaucauggccgugggcauggucagcauccuggcguccagccugcucaagaacgacauccccaugaccggcccccugguggccgggggccugcucacggugugcuacguccugaccgggcggagcgccgaccuggagcucgagcgcgccgccgacgugaagugggaggaccaggcggagaucuccggcagcucccccauccugagcaucaccaucuccgaggacgggagcauguccaucaagaacgaggaggaggagcagacccugacgauccucauccggaccggccugcuggugaucagcggcgucuucccgguguccauccccaucaccgccgccgccugguaccucugggaggugaagaagcagcgcgccgggguccugugggacgugcccagcccgccgcccgugggcaaggcggagcuggaggacggggccuaccggaucaagcagcgcggcauccucggguacucccagaucggcgccggcgucuacaaggaggggaccuuccacaccauguggcacgugacgcggggcgccgugcugaugcaccgcgggaagcggaucgagcccagcugggccgacgucaagaaggaccugaucuccuacggcgggggcuggaagcucgagggcgaguggaaggagggggaggagguccaggugcuggcgcuggagcccggcaagaacccccgcgccguccagaccaagcccggccucuucaagaccaacaccggcacgaucggggccgugagccuggacuucucccccggcaccagcggcucccccaucguggaccggaaggggaaggucgugggccuguacgggaacggcguggucacccgcagcggcgccuacguguccgcgaucgcccagaccgagaaguccaucgaggacaaccccgagaucgaggacgacaucuuccggaagaagcgccucacgaucauggaccugcaccccggggccggcaagaccaagcgguaccugcccgccaucgugcgcgaggccaucaagcgggggcugcgcacccucauccuggcgccgacccgcgucguggccgccgagauggaggaggcccugcggggccuccccauccgcuaccagacgcccgccauccgggcggagcacaccgggcgcgagaucguggaccugaugugccacgccaccuucaccaugcggcugcucagccccguccgcgugccgaacuacaaccugaucaucauggacgaggcccacuucacggaccccgccuccaucgccgcgcggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucacggacuucaagggcaagaccgugugguucgugccguccaucaaggccgggaacgacaucgccgccugccugcgcaagaacggcaagaaggucauccagcucagccggaagaccuucgacuccgaguacgugaagacccgcgccaacgacugggacuucguggucacgaccgacaucagcgagaugggcgcgaacuucaaggccgagcgggugaucgacccccgccggugcaugaagcccgugauccugaccgacggggaggagcgcgucauccuggccggccccaugccggugacccacuccagcgccgcccagcggcgcgggcgcaucggccggaaccccaagaacgagaacgaccaguacaucuacaugggggagccccucgagaacgacgaggacugcgcgcacuggaaggaggccaagaugcugcuggacaacaucaacacgcccgagggcaucaucccguccauguucgagcccgagcgcgagaagguggacgccaucgacggcgaguaccggcuccgcggggaggcccggaagaccuucgucgaccugaugcgccggggcgaccugcccguguggcucgccuaccgcguggcggccgaggggaucaacuacgccgaccggcgcuggugcuucgacggcaucaagaacaaccagauccuggaggagaacgucgagguggagaucuggaccaaggagggggagcggaagaagcugaagccgcgcuggcucgacgcccggaucuacagcgacccccuggcgcugaaggaguucaaggaguucgccgccggccgcaagucccucacccugaaccugaucacggagaugggccggcuccccaccuucaugacccagaaggcccgcgacgcccuggacaaccuggcggugcuccacaccgccgaggccgggggcaaggccuacaaccacgcccugagcgagcugcccgagacgcucgagacccugcugcuccugacccugcucgcgaccgucaccggcgggaucuuccuguuccugauguccgggaaggggaucggcaagaugacccucgggaugugcugcaucaucaccgccagcauccugcugugguacgcccagauccagccgcacuggaucgccgccuccaucauccucgaguucuuccugaucgugcugcucauccccgagcccgagaagcagcggacgccccaggacaaccagcugaccuacgucgugaucgcgauccugacgguggucgccgccaccauggccaacgagaugggcuuccucgagaagaccaagaaggaccuggggcugggcagcaucaucacccaggagagcgaguccaacauccucgacaucgaccugcgcccggccagcgcguggacgcuguacgccguggccaccaccuucgugacccccaugcuccggcacuccaucgagaacagcuccgucaacgugagccugacggccaucgcgaaccaggccaccgugcugaugggccucgggaagggcuggccccuguccaagauggacaucggggucccccugcucgccaucggcugcuacagccaggugaacccgaucacccugaccgccgcccugcuccugcugguggcgcacuacgccaucaucgggcccggccuccaggccaaggccacgcgcgaggcccagaagcgggcggccgccggcaucaugaagaaccccaccgucgacgggaucaccgugaucgaccuggagcccaucccguacgaccccaaguucgagaagcagcugggccaggugaugcuccugauccugugcgucacccaggugcucaugaugcgcacgaccugggcccugugcgaggcccugacccucgcgaccgggcccaucuccacgcugugggagggcaaccccgggcgcuucuggaacaccaccaucgccgugagcauggccaacaucuuccggggcuccuaccuggccggcgcggggcuccuguucagcaucaugaagaacaccacgaacacccgccggggcaccgggaacaucggcgagacccugggcgagaaguggaagucccgccucaacgcccugggcaagagcgaguuccagaucuacaagaaguccggcauccaggaggucgaccggacgcuggccaaggaggggaucaagcgcggcgagaccgaccaccacgccgugagccggggguccgccaagcuccgcugguucguggagcggaacauggucaccccggagggcaaggugguggaccugggcugcgggcgcggcggguggagcuacuacugcggcgggcugaagaacguccgggaggugaagggccucaccaagggcgggcccggccacgaggagcccauccccauguccacguacggguggaaccuggugcgccugcagagcggcgucgacguguucuucaccccgcccgagaagugcgacacccuccugugcgacaucggggagagcucccccaaccccaccaucgaggcgggccggacgcugcgcgugcucaaccuggucgagaacuggcugaacaacaacacccaguucugcaucaaggugcucaacccguacaugcccagcgugaucgagaagauggagacccugcagcggaaguacggcggggcccugguccgcaacccccugucccggaacagcacccacgagauguacuggguguccaacgccaccggcaacaucgugagcuccgucaacaugaucagccgcaugcucaucaaccgguucacgaugaagcacaagaaggccaccuacgagccggacguggaccugggguccggcacccgcaacaucgggaucgagagcgagauccccaaccuggacaucaucggcaagcgcaucgagaagaucaagcaggagcacgagaccuccuggcacuacgaccaggaccaccccuacaagacgugggccuaccacggcagcuacgagaccaagcagaccggguccgcgagcuccauggugaacggcgucgugcggcuccugaccaagcccugggacguggucccgauggugacgcagauggccaugaccgacaccacccccuucgggcagcagcgcguguucaaggagaaggucgacacgcggacccaggagcccaaggagggcaccaagaagcugaugaagaucaccgccgaguggcucuggaaggagcugggcaagaagaagacgccccgcaugugcacccgggaggaguucacccgcaaggugcggagcaacgccgcccugggggcgaucuucaccgacgagaacaaguggaaguccgcccgcgaggccguggaggacagccgguucugggagcucgucgaccgcgagcggaaccugcaccuggagggcaagugcgagacgugcguguacaacaugauggggaagcgcgagaagaagcucggcgaguucgggaaggccaagggcucccgggcgaucugguacauguggcugggcgcccgcuuccuggaguucgaggcccucggguuccugaacgaggaccacugguucagccggggcaacagccuguccgggguggagggcgaggggcuccaccgccugggcuacauccugcgggacgucagcaagaaggagggcggggccauguacgccgacgacaccgcgggcugggacacccgcaucacccucgaggaccugaagaacgaggagauggugacgaaccacaugaagggggagcacaagaagcuggccgaggccaucuucaagcucaccuaccagaacaaggucgugcgggugcagcgcccgacgccccggggcaccgucauggacaucaucucccgccgcgaccagcgggggagcggccaggugggcacguacgggcugaacaccuucaccaacauggaggcccagcugauccgccagauggagggcgaggggaucuucaaguccauccagcaccucaccgugacggaggagaucgccguccagaacuggcuggcgcgggugggccgcgagcggcugagccgcauggccaucuccggcgacgacugcguggucaagccccucgacgaccgguucgccagcgcccugaccgcccugaacgacauggggaaggugcgcaaggacauccagcagugggagcccucccggggcuggaacgacuggacccaggugccguucugcagccaccacuuccacgagcucgucaugaaggacgggcgcgugcuggugguccccugccggaaccaggacgagcugaucggccgcgcgcggaucucccagggggccggcuggagccucaaggagaccgccugccugggcaaguccuacgcccagauguggacgcugauguacuuccaccgccgggaccuccgccuggccgcgaacgccaucugcagcgccgugcccucccacugggugcccaccagccggaccaccugguccauccacgccaaccacgaguggaugaccacggaggacaugcuggcggucuggaaccgcguguggauccaggagaacccguggauggaggacaagacccccguggagagcugggaggagguccccuaccucgggaagcgggaggaccaguggugcggcagccugaucgggcugaccucccgcgccaccugggccaagaacauccagacggccaucaaccaggugcgcagccucaucggcaacgaggaguacaccgacuacaugcccuccaugaagcgguuccgccgggaggaggaggaggccggggugcugugguga

SEQ ID NO: 9753 - RNA, 9876 nt, Artificial Sequence
  derived and/or modified CDS sequence (opt1) from DENV-2__GQ398308__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacuccaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagacguggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucgugugcaagcacuccaugguggaccggggcugggggaacggcugcggccucuucggcaagggcgggaucgugaccugcgcgauguucacgugcaagaagaacauggagggcaagguggugcugcccgagaaccuggaguacaccaucgucaucacgccccacagcggggaggagcacgccgugggcaacgacaccgggaagcacggcaaggagaucaagaucaccccgcaguccagcaucaccgaggccgagcucaccggguacggcacggugaccauggagugcagcccccggaccggccuggacuucaacgagaugguccugcuccagauggaggacaaggccuggcuggugcaccggcagugguuccuggaccucccccugcccuggcugccgggggccgacacccagggcagcaacuggauccagaaggagacgcucgugaccuucaagaacccccacgcgaagaagcaggacgucgugguccuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccucgagaagcggcacgugcuggggcgccugaucaccgugaacccgaucgucgcggagaaggacagccccgugaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcgcugcaccagguguucggcgccaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggcgaugguccaggccgacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggcgggcaagcggucccugcgcccgcagcccaccgagcucaaguacagcuggaagaccuggggcaaggccaagaugcuguccaccgagagccacaaccagacguuccugaucgacgggcccgagaccgccgagugcccgaacaccaaccgggccuggaacucccucgaggucgaggacuacggcuucgggguguucagcaccaacaucuggcugaagcugcgcgagaagcaggacguguucugcgacuccaagcucaugagcgccgcgaucaaggacaaccgggccguccacgccgacaugggcuacuggaucgaguccgcccugaacgacacguggaagauggagaaggccagcuucaucgaggugaaguccugccacuggcccaagagccacacccugugguccaacggcgugcucgagagcgagaugaucauccccaagaacuucgcggggcccgucagccagcacaacuaccgcccgggcuaccacacccagaccgccgggcccuggcaccugggcaagcuggagauggacuucgacuucugcgaggggaccacggugguggucaccgaggacugcggcaaccggggccccucccuccgcaccaccacggccagcgggaagcugaucaccgaguggugcugccgguccugcacccugcccccgcuccgcuaccggggcgaggacgggugcugguacggcauggagauccgcccccugaaggagaaggaggagaaccuggugaacagccucgugaccgccgggcacggccagaucgacaacuucucccugggcguccuggggauggcccucuuccuggaggagaugcugcggacgcgcgugggcaccaagcacgccaugcuccugguggccgucagcuucgugacccugaucaccgggaacauguccuuccgggaccucggccgcgugauggucauggugggggccacgaugaccgacgacaucggcaugggcaucaccuaccuggcccugcucgcggccuucaaggugcgccccaccuucgccgccgggcugcugcuccggaagcugacgagcaaggagcugaugauggccaccaucggcaucgcgcuccugucccagagcaccauccccgagaccauccuggagcucacggacgcccuggcccuggggaugaugguccucaagaucgugcgcaacauggagaaguaccagcuggccgugaccaucauggccaucuccugcgucccgaacgcggugauccugcagaacgccuggaaggugagcugcaccauccucgccgccgucuccgugagcccccugcugcucaccuccagccagcagaaggcggacuggaucccccuggcccugacgaucaagggccucaaccccaccgccaucuuccugaccacccugucccggacgagcaagaagcgcuccuggccgcucaacgaggccaucauggccgucggcauggugagcauccuggcgagcucccugcucaagaacgacauccccaugaccgggccccugguggccggcgggcugcucaccgucugcuacgugcugaccggccggagcgccgaccuggagcucgagcgcgccgccgacgugaagugggaggaccaggcggagaucuccgggagcucccccauccugagcaucacgaucuccgaggacggcagcauguccaucaagaacgaggaggaggagcagacccugaccauccucauccggaccggccugcuggucaucagcgggguguucccgguguccauccccaucacggccgccgccugguaccucugggaggucaagaagcagcgcgccggcgugcugugggacgugcccagcccgccgcccgucgggaaggcggagcuggaggacggcgccuaccggaucaagcagcgcgggauccucggcuacucccagaucggcgccgggguguacaaggagggcaccuuccacaccauguggcacgugacccgcggggcgguccugaugcaccgcggcaagcggaucgagcccagcugggccgacgugaagaaggaccugaucuccuacgggggcggcuggaagcucgagggggaguggaaggagggcgaggaggugcagguccuggcgcuggagcccgggaagaacccccgcgccgugcagaccaagcccggccucuucaagacgaacaccgggaccaucggcgccgugagccuggacuucucccccggcaccagcgggucccccaucgucgaccggaagggcaaggugguggggcuguacggcaacggcgucgugacgcgcagcggggccuacgugagcgcgaucgcccagaccgagaaguccaucgaggacaaccccgagaucgaggacgacaucuuccggaagaagcgccucaccaucauggaccugcaccccggcgccgggaagaccaagcgguaccugcccgccaucguccgcgaggccaucaagcggggccugcgcacgcucauccuggcgccgacccgcgugguggccgccgagauggaggaggcccugcgggggcuccccauccgcuaccagacccccgccauccgggcggagcacaccggccgcgagaucgucgaccugaugugccacgccacguucaccaugcggcugcucagccccgugcgcgugccgaacuacaaccugaucaucauggacgaggcccacuucaccgaccccgccuccaucgccgcgcggggcuacaucagcacccgcgucgagaugggggaggccgccggcaucuucaugacggccacgccgcccgggucccgggacccguucccccagagcaacgcgcccaucauggacgaggagcgcgagauccccgagcgguccuggaacagcggccacgagugggugaccgacuucaaggggaagaccgugugguucgucccguccaucaaggccggcaacgacaucgccgccugccugcgcaagaacggcaagaaggugauccagcucagccggaagacguucgacuccgaguacgugaagacccgcgccaacgacugggacuucgucgugaccaccgacaucagcgagaugggggcgaacuucaaggccgagcgggugaucgacccccgccggugcaugaagcccgucauccugacggacggcgaggagcgcgugauccuggccgggcccaugccggugacccacuccagcgccgcccagcggcgcggccgcaucgggcggaaccccaagaacgagaacgaccaguacaucuacaugggcgagccccucgagaacgacgaggacugcgcgcacuggaaggaggccaagaugcugcuggacaacaucaacacccccgagggcaucaucccguccauguucgagcccgagcgcgagaaggucgacgccaucgacggggaguaccggcuccgcggcgaggcccggaagaccuucguggaccugaugcgccgcggggaccugcccguguggcucgccuaccgcgucgcggccgagggcaucaacuacgccgaccggcgcuggugcuucgacgggaucaagaacaaccagauccuggaggagaacguggagguggagaucuggacgaaggagggcgagcggaagaagcugaagccgcgcuggcucgacgcccggaucuacagcgacccccuggcgcugaaggaguucaaggaguucgccgccggccgcaagucccucacccugaaccugaucaccgagauggggcggcuccccaccuucaugacgcagaaggcccgcgacgcccuggacaaccuggcgguccuccacaccgccgaggccggcgggcgggccuacaaccacgcccugagcgagcugcccgagacccucgagacccugcugcuccugacgcugcucgcgaccgugaccggcggcaucuuccuguuccugauguccgggaagggcaucgggaagaugacccucggcaugugcugcaucaucacggccagcauccugcugugguacgcccagauccagccgcacuggaucgccgccagcaucauccucgaguucuuccugaucguccugcucauccccgagcccgagaagcagcgcacgccccaggacaaccagcugaccuacguggugaucgcgauccugaccgucguggccgccaccauggccaacgagaugggguuccucgagaagacgaagaaggaccugggccugggcuccaucgccacccaggagagcgaguccaacauccucgacaucgaccugcggccggcgagcgccuggacccuguacgccguggccaccacguucgucacccccaugcuccgccacuccaucgagaacagcuccgugaacgugagccugaccgcgaucgccaaccaggccaccguccugauggggcucggcaagggguggccccuguccaagauggacaucggcgugccccugcucgccaucgggugcuacagccaggugaacccgaucacgcugaccgccgcgcugcuccugcuggucgcccacuacgccaucaucggccccggccuccaggccaaggccacccgggaggcgcagaagcgcgccgccgccgggaucaugaagaaccccaccguggacggcaucacggugaucgaccuggagcccaucccguacgaccccaaguucgagaagcagcuggggcaggucaugcuccugauccugugcgugacccaggugcucaugaugcgcaccaccugggcccugugcgaggcgcugacgcucgccaccggccccaucuccacccugugggaggggaaccccggccgguucuggaacaccacgaucgccgucagcauggccaacaucuuccgcggcuccuaccuggcgggggccggccuccuguucagcaucaugaagaacaccaccaacacccggcgcgggacgggcaacaucggcgagacccugggggagaaguggaagucccggcucaacgcccugggcaagagcgaguuccagaucuacaagaaguccgggauccaggagguggaccgcacccuggccaaggagggcaucaagcgcggggagaccgaccaccacgccgugagccgcggcuccgcgaagcuccggugguucgucgagcgcaacauggugacgccggagggcaagguggucgaccuggggugcggccgcggcggguggagcuacuacugcggcgggcugaagaacgugcgcgaggugaaggggcucaccaagggcgggcccgggcacgaggagcccauccccaugagcaccuacggcuggaaccugguccggcugcaguccgggguggacguguucuucaccccgcccgagaagugcgacacgcuccugugcgacaucggcgagagcucccccaaccccaccaucgaggccggccgcacccugcggguccucaaccugguggagaacuggcugaacaacgacacccaguucugcaucaaggugcucaacccguacaugcccagcgucaucgagaagauggagacgcugcagcgcaaguacgggggcgccaucgugcggaacccccugucccgcaacagcacccacgagauguacuggguguccaacgccaccgggaacaucgucagcuccgugaacaugaucagccggaugcugaucaaccgcuucaccaugaagcacaagaaggccaccuacgagccggacguggaccucggcuccgggacgcgcaacaucggcaucgagagcgagauccccaaccuggacaucaucggcaagcggaucgagaagaucaagcaggagcacgagaccuccuggcacuacgaccaggaccaccccuacaagaccugggcguaccacgggagcuacgagaccaagcagacgggcuccgccagcuccauggucaacgggguggugcgccugcucaccaagcccugggacgucgugccgauggugacccagauggccaugaccgacacgacccccuucggccagcagcgggucuucaaggagaagguggacacccgcacccaggagcccaaggagggcacgaagaagcugaugaagaucaccgccgaguggcuguggaaggagcucgggaagaagaagacgccccggaugugcacccgcgaggaguucacgcggaaggugcgcagcaacgccgcgcugggcgccaucuucaccgacgagaacaaguggaaguccgcccgggaggccgucgaggacagccgcuucugggagcugaucgaccgggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucucccgcgggaacagccuguccggcguggagggggagggccugcaccggcucggcuacauccugcgcgacgucagcaagaaggagggcggcgccauguacgcggacgacaccgccgggugggacacgcggaucacccuggaggaccucaagaacgaggagauggugaccaaccacaugaagggcgagcacaagaagcuggccgaggccaucuucaagcugaccuaccagaacaaggucgugcgcgugcagcggccgacgccccgcgggaccgucauggacaucaucucccgccgggaccagcgcggcagcggccagguggggaccuacggccucaacaccuucacgaacauggaggcccagcugauccggcagauggagggggagggcaucuucaaguccauccagcaccugaccgugaccgaggagaucgcgguccagaacuggcucgcccgcgugggccgggagcgccugagccggauggccaucuccggggacgacugcguggucaagccccuggacgaccgcuucgccagcgcccucaccgcgcugaacgacaugggcaaggugcggaaggacauccagcagugggagcccucccgcggguggaacgacuggacccaggucccguucugcagccaccacuuccacgagcuggucaugaaggacggccgggugcucgugguccccugccgcaaccaggacgagcugaucgggcgggcccgcaucucccagggcgccggcuggagccugaaggagaccgccugccucgggaaguccuacgcccagauguggacccugauguacuuccaccggcgcgaccugcggcucgcggccaacgccaucugcagcgccgugcccucccacugggugcccaccagccgcacgaccuggagcauccacgcgaagcacgaguggaugaccaccgaggacaugcugaccgucuggaaccggguguggauccaggagaacccguggauggaggacaagacgcccguggaguccugggaggagguccccuaccugggcaagcgcgaggaccaguggugcgggagccucaucggccugaccucccgcgccaccugggccaagaacauccagaccgccaucaaccaggugcggagccugaucgggaacgaggaguacacggacuacaugcccuccaugaagcgcuuccggcgcgaggaggaggaggccggcgugcucugguga

SEQ ID NO: 9754 - RNA, 9876 nt, Artificial Sequence
  derived and/or modified CDS sequence (opt1) from DENV-2__GQ398287__SS-prME
accgccggggugaucaucaugcugauccccaccgccauggcguuccaccucaccacccgcaacggggagccgcacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucgccaucauggcggccauccuggccuacaccaucgggaccacccacuuccagcgggcccucaucuucauccugcugacggcgguggcccccagcaugaccaugcgcugcaucggcaucuccaaccgggacuucguggagggcgucagcgggggcuccuggguggacaucgugcucgagcacgggagcugcgucaccaccauggccaagaacaagcccacgcuggacuucgagcugaucaagaccgaggccaagcagcccgccacccuccgcaaguacugcaucgaggcgaagcugaccaacacgaccaccgagucccggugcccgacccagggcgagcccagccugaacgaggagcaggacaagcgcuucgugugcaagcacuccaugguggaccggggcugggggaacggcugcggccuguucggcaagggcgggaucgucacgugcgccauguucacgugcaagaagaacauggagggcaagguggugcugcccgagaaccuggaguacaccaucgucaucacgccccacagcggggaggagcacgccgugggcaacgacacggggaagcacggcaaggagaucaagaucaccccgcaguccagcaucaccgaggccgagcucaccggguacggcaccgugacgauggagugcagcccccgcaccggccuggacuucaacgagaugguccugcuccagauggaggacaaggccuggcuggugcaccggcagugguuccuggaccucccccugcccuggcugccgggggcggacacccagggcagcaacuggauccagaaggagacccucgugacguucaagaacccccacgccaagaagcaggacgucgugguccuggggucccaggagggcgccaugcacaccgcccugaccggggccaccgagauccagaugagcagcggcaaccuccuguucacgggccaccugaagugccgccuccggauggacaagcugcagcugaaggggauguccuacagcaugugcaccggcaaguucaagaucgugaaggagaucgcggagacccagcacgggaccaucgugauccgcguccaguacgagggcgacggcucccccugcaagauccccuucgagaucauggaccucgagaagcggcacgugcuggggcgccugaucacggugaacccgaucgucaccgagaaggacagccccgugaacaucgaggccgagccgcccuucggcgacuccuacaucaucaucgggguggagccgggccagcucaagcugaacugguucaagaaggggagcuccaucggccagauguucgagaccaccaugcgcggcgccaagcggauggccauccugggggacacggccugggacuucggcagccucgggggcgucuucaccuccaucgggaaggcgcugcaccagguguucggcgccaucuacggcgccgccuucagcgggguguccuggaccaugaagauccugaucggcgucaucaucaccuggaucgggaugaacagccgcuccacgagccuguccgugagccucgugcuggucggcguggugacccuguaccucggggcgaugguccaggccgacuccggcugcguggugagcuggaaguccaaggagcugaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccucgagaaccugauguggaagcagaucacccccgagcugaaccacauccucagcgagaacgaggugaagcugaccaucaugacgggcgacaucaaggggaucaugcaggcgggcaagcggucccugcgcccgcagcccaccgagcucaaguacagcuggaagaccuggggcaaggccaagaugcuguccaccgagagccacaaccagacguuccugaucgacgggcccgagaccgccgagugcccgaacaccaaccgggccuggaacucccucgaggucgaggacuacggcuucgggguguucaccacgaacaucuggcugaagcugcgcgagaagcaggacguguucugcgacagcaagcucauguccgccgcgaucaaggacaaccgggccguccacgccgacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaaccuggcggggcccgugagccagcacaacuaccgcccgggcuaccacacccagaccgccgggcccuggcaccugggcaagcucgagauggacuucgacuucugcgaggggacgaccgugguggucaccgaggacugcggcaaccggggccccagccugcgcaccacgaccgccuccgggaagcugaucaccgaguggugcugccggagcugcacccucccgccccugcgcuaccggggcgaggacgggugcugguacggcauggagauccgcccccugaaggagaaggaggagaaccucgugaacucccuggugacggccgggcacggccagaucgacaacuucagccugggcguccucgggauggcgcuguuccuggaggagaugcuccggacccgcgugggcaccaagcacgccauccugcugaucgccguguccuucgucacccucaucacggggaacaugagcuuccgggaccugggccgcgugauggugauggucggggccaccaugaccgacgacaucggcaugggcgugaccuaccuggcccuccuggcggccuucaaggugcgccccacguucgccgccgggcugcuccugcggaagcugaccuccaaggagcucaugauggccaccaucggcaucgcgcugcugagccaguccaccauccccgagacgauccucgagcugaccgacgcccuggcccucgggaugaugguccugaagaucgugcgcaacauggagaaguaccagcuggccgugaccaucauggccaucagcugcguccccaacgcggugauccuccagaacgccuggaagguguccugcaccauccuggccgccgucagcgugagcccccugcuccugacgagcucccagcagaaggcggacuggaucccccuggcccucaccaucaagggccugaaccccaccgccaucuuccugaccacgcucagccggaccuccaagaagcgcagcuggccgcugaacgaggccaucauggccgucggcaugguguccauccuggcgagcagccuccugaagaacgacauccccaugaccgggccccugguggccggcgggcuccugaccgucugcuacgugcugacgggccgguccgccgaccucgagcuggagcgcgccgccgacgugaagugggaggaccaggcggagaucagcggguccagccccauccuguccaucaccaucagcgaggacggcuccaugagcaucaagaacgaggaggaggagcagacccucaccauccugauccggacgggccugcucgucaucuccgggguguucccggugagcauccccaucaccgccgccgccugguaccugugggaggucaagaagcagcgcgccggcgugcugugggacgugcccagcccgccgcccgucgagaaggcggagcucgaggacggggccuaccggaucaagcagcgcggcauccugggguacagccagaucggcgccggcguguacaaggaggggaccuuccacaccauguggcacgugacccggggcgccguccugaugcaccgcgggaagcggaucgagcccuccugggccgacgugaagaaggaccucaucagcuacggcgggggcuggaagcuggagggcgaguggaaggagggggaggaggugcagguccuggcgcucgagcccggcaagaacccccgcgccgugcagacgaagcccgggcuguucaagaccaacaccggcaccaucggggccgugucccuggacuucagccccggcacguccggcagccccaucgucgaccggaaggggaagguggugggccucuacgggaacggcgucgugacccgcuccggcgccuacgugagcgcgaucgcccagaccgagaaguccaucgaggacaaccccgagaucgaggacgacaucuuccggaagaagcgccugaccaucauggaccugcaccccggggccggcaagacgaagcgguaccugcccgccaucguccgcgaggccaucaagcgggggcuccgcacccugauccuggcgccgacccgcgugguggccgccgagauggaggaggcccuccggggccugcccauccgcuaccagacccccgccauccgggcggagcacacggggcgcgagaucgucgaccugaugugccacgccaccuucaccaugcggcuccugucccccgugcgcgugccgaacuacaaccugaucaucauggacgaggcccacuucaccgaccccgccagcaucgccgcgcggggcuacaucuccacgcgcgucgagaugggcgaggccgccgggaucuucaugaccgccacgccgcccggcagccgggacccguucccccaguccaacgcgcccaucauggacgaggagcgcgagauccccgagcggagcuggaacuccgggcacgagugggugaccgacuucaagggcaagacggugugguucgucccgagcaucaaggccgggaacgacaucgccgccugccuccgcaagaacggcaagaaggugauccagcugucccggaagaccuucgacagcgaguacgugaagacccgcgccaacgacugggacuucgucgugaccacggacaucuccgagaugggcgcgaacuucaaggccgagcgggugaucgacccccgccggugcaugaagcccgucauccugaccgacggggaggagcgcgugauccucgccggccccaugccggugacccacagcuccgccgcccagcggcgcgggcgcaucggccggaaccccaagaacgagaacgaccaguacaucuacaugggggagccccuggagaacgacgaggacugcgcgcacuggaaggaggccaagaugcugcucgacaacaucaacacccccgagggcaucaucccgagccuguucgagcccgagcgcgagaaggucgacgccaucgacggcgaguaccggcugcgcggggaggcccggaagacguucguggaccucaugcgccggggcgaccugcccguguggcuggccuaccgcgucgcggccgaggggaucaacuacgccgaccggcgcuggugcuucgacggcaucaagaacaaccagauccucgaggagaacguggagguggagaucuggaccaaggagggggagcggaagaagcugaagccgcgcuggcuggacgcccggaucuacuccgacccccucgcgcugaaggaguucaaggaguucgccgccggccgcaagagccugacccucaaccugaucaccgagaugggccggcugcccacguucaugacccagaaggcccgcgacgcccucgacaaccuggcgguccugcacaccgccgaggccgggggccgggccuacaaccacgcccucuccgagcugcccgagacccuggagacgcuccugcugcucacccugcuggcgaccgugaccgggggcaucuuccucuuccugaugagcggccgcgggaucggcaagaugacgcuggggaugugcugcaucaucaccgccuccauccuccugugguacgcccagauccagccgcacuggaucgccgccagcaucauccuggaguucuuccucaucguccugcugauccccgagcccgagaagcagcggacgccccaggacaaccagcucaccuacguggugaucgcgauccugaccgucguggccgccacgauggccaacgagaugggcuuccuggagaagaccaagaaggaccucgggcugggcagcaucaccacccaggaguccgagagcaacauccuggacaucgaccuccgcccggccuccgcguggacgcuguacgccguggccaccaccuucgucacccccaugcugcggcacagcaucgagaacuccagcgugaacgugucccucacggccaucgcgaaccaggccaccguccugaugggccuggggaagggcuggccccucagcaagauggacaucggggugccccugcuggccaucggcugcuacucccaggugaacccgaucacccucaccgccgcccugcugcuccuggucgcgcacuacgccaucaucgggcccggccugcaggccaaggccacgcgcgaggcccagaagcgcgcggccgccggcaucaugaagaaccccaccguggacgggaucaccgugaucgaccucgagcccaucccguacgaccccaaguucgagaagcagcugggccaggucaugcugcucauccugugcgugacccaggugcugaugaugcggacgaccugggcccucugcgaggcccugacccuggcgaccgggcccaucagcacgcucugggagggcaaccccgggcgcuucuggaacaccaccaucgccgucuccauggccaacaucuuccggggcagcuaccuggccggcgcggggcuccucuucuccaucaugaagaacaccacgaacacccgccggggcaccgggaacaucggcgagacccugggcgagaaguggaagucccgccugaacgcccucggcaagagcgaguuccagaucuacaagaaguccgggauccaggagguggaccggacgcuggccaaggaggggaucaagcgcggcgagaccgaccaccacgccgugucccgggggagcgccaagcugcgcugguucgucgagcggaacauggugaccccggagggcaagguggucgaccucggcugcgggcgcggcgggugguccuacuacugcggcgggcugaagaacgugcgggaggugaagggccugaccaagggcgggcccggccacgaggagcccauccccaugagcacguacggguggaaccucguccgccugcagagcggcguggacguguucuucaccccgcccgagaagugcgacaccguccugugcgacaucggggaguccagccccaaccccaccaucgaggcgggccggacgcuccgcgugcugaaccugguggagaacuggcucaacaacaacacccaguucugcaucaagguccugaacccguacaugcccuccgugaucgagaagauggagacccugcagcggaaguacggcggggcccuggugcgcaacccccucagccggaacuccacccacgagauguacugggucagcaacgccaccggcaacaucguguccagcgugaacaugaucucccgcaugcugaucaaccgcuucacgaugaagcacaagaaggccaccuacgagccggacgucgaccuggggagcggcacccggaacaucgggaucgaguccgagauccccaaccucgacaucaucggcaagcgcaucgagaagaucaagcaggagcacgagaccagcuggcacuacgaccaggaccaccccuacaagacgugggccuaccacggcuccuacgagaccaagcagaccgggagcgcguccagcauggugaacggcgugguccggcugcugaccaagcccugggacguggugccgauggucacgcagauggccaugaccgacaccacccccuucgggcagcagcgcguguucaaggagaagguggacacgcggacccaggagcccaaggagggcaccaagaagcucaugaagaucaccgccgaguggcuguggaaggagcugggcaagaagaagacgccccgcaugugcacccgggaggaguucacccgcaagguccgguccaacgccgcccucggggcgaucuucaccgacgagaacaaguggaaguccgcccgcgaggccguggaggacucccgguucugggagcugaucgaccgcgagcggaaccugcaccucgagggcaagugcgagacgugcguguacaacaugauggggaagcgcgagaagaagcugggcgaguucgggaaggccaagggcagccgggcgaucugguacauguggcugggcgcccgcuuccucgaguucgaggcccugggguuccugaacgaggaccacugguucagccggcgcaacucccucagcggcgucgagggggagggccugcaccggcugggguacauccuccgcgacguguccaagaaggagggcggcgccauguacgccgacgacaccgcggggugggacacccggaucacccuggaggaccugaagaacgaggagauggucacgaaccacaugaagggcgagcacaagaagcucgccgaggccaucuucaagcugaccuaccagaacaagguggugcgcguccagcgcccgacgccccgggggaccgugauggacaucaucagccgccgggaccagcgcggcuccggccaggugggcaccuacggccugaacaccuucaccaacauggaggcccagcucauccggcagauggagggggagggcaucuucaagagcauccagcaccugaccgucacggaggagaucgccgugcagaacuggcuggcgcgcguggggcgggagcgccucucccggauggccaucagcggcgacgacugcgucgugaagccccuggacgaccgcuucgccuccgcccugaccgcccucaacgacaugggcaaggugcggaaggacauccagcagugggagcccagccgcggguggaacgacuggacccaggucccguucugcucccaccacuuccacgagcuggugaugaaggacggccgggugcuggucgugcccugccgcaaccaggacgagcucaucgggcgggcgcgcaucagccagggcgccggguggucccugaaggagaccgccugccugggcaagagcuacgcccagauguggacgcucauguacuuccaccggcgcgaccugcggcuggccgcgaacgccaucugcuccgccgugcccagccacuggguccccaccucccgcaccaccuggagcauccacgccaagcacgaguggaugaccacggaggacaugcucgcgguguggaaccgcguguggauccaggagaacccguggauggaggacaagacccccgucgagagcugggaggaggugcccuaccugggcaagcgggaggaccaguggugcgggucccugaucggccucaccagccgcgccaccugggccaagaacauccagacggccaucaaccaggugcggucccugaucgggaacgaggaguacaccgacuacaugcccagcaugaagcgcuuccggcgcgaggaggaggaggccggcguccugugguga

SEQ ID NO: 9755 - RNA, 9876 nt, Artificial Sequence
  derived and/or modified CDS sequence (opt1) from DENV-2__GQ398302__SS-prME
accgcgggggucaucaucaugcugauccccaccgccauggcguuccaccucaccacccgcaacggggagccccacaugaucgucagccggcaggagaagggcaagagccugcuguucaagaccgaggacggggugaacaugugcacccucauggccaucgaccugggggagcugugcgaggacaccaucaccuacaagugcccccuccugcgccagaacgagcccgaggacaucgacugcuggugcaacagcaccuccaccugggugaccuacgggaccugcaccaccaccggcgagcaccggcgcgagaagcggagcgucgcccuggugccccacgugggcauggggcucgagacccgcaccgagaccuggauguccagcgagggcgccuggaagcacguccagcggaucgagaccuggauccugcgccacccgggguucaccaucauggccgcgauccuggccuacaccaucggcaccacgcacuuccagcgggcccucaucuucauccugcugaccgccguggcgcccuccaugaccaugcgcugcaucgggaucagcaaccgggacuucguggagggcgucuccggcgggagcuggguggacaucgugcucgagcacggcuccugcgucaccacgauggccaagaacaagcccacccuggacuucgagcugaucaagaccgaggccaagcagcccgccacccuccgcaaguacugcaucgaggccaagcugacgaacaccaccaccgagagccggugcccgacgcagggggagcccucccugaacgaggagcaggacaagcgcuucgugugcaagcacagcaugguggaccggggcuggggcaacgggugcggccucuucgggaagggcgggaucgugaccugcgcgauguucacgugcaagaagaacauggagggcaagguggugcugcccgagaaccuggaguacaccaucgucaucacgccccacuccggcgaggagcacgccguggggaacgacaccggcaagcacgggaaggagaucaagaucaccccgcagagcuccaucaccgaggccgagcucaccggcuacgggacggugaccauggagugcagcccccgcaccggccuggacuucaacgagaugguccugcuccagauggaggacaaggccuggcuggugcaccggcagugguuccuggaccucccccugcccuggcugccgggcgccgacacccagggguccaacuggauccagaaggagacgcucgugaccuucaagaacccccacgcgaagaagcaggacgucgugguccugggcagccaggagggggccaugcacaccgcccugaccggcgccacggagauccagaugagcuccgggaaccuccuguucaccggccaccugaagugccgccuccggauggacaagcugcagcugaagggcaugagcuacuccaugugcaccgggaaguucaagaucgugaaggagaucgccgagacccagcacggcacgaucgugauccgcguccaguacgagggggacggcagccccugcaagauccccuucgagaucauggaccucgagaagcggcacgugcugggccgccugaucaccgugaacccgaucgucgcggagaaggacucccccgugaacaucgaggccgagccgcccuucggggacagcuacaucaucaucggcguggagccggggcagcucaagcugaacugguucaagaagggcuccagcaucgggcagauguucgagaccaccaugcgcggcgccaagcggauggccauccugggcgacacggccugggacuucgggucccucggcggggucuucaccagcaucggcaaggcgcugcaccagguguucggggccaucuacggcgccgccuucuccggcgugagcuggaccaugaagauccugaucggggucaucaucaccuggaucggcaugaacucccgcagcacgucccugagcgugucccucgugcuggucgggguggugacccuguaccucggcgcgaugguccaggccgacagcgggugcgugguguccuggaaguccaaggagcugaagugcggcagcggcaucuucaucaccgacaacguccacaccuggacggagcaguacaaguuccagcccgagucccccagcaagcuggccuccgccauccagaaggcccacgaggaggggaucugcggcauccggagcgugacccgccucgagaaccugauguggaagcagaucacccccgagcugaaccacauccucuccgagaacgaggugaagcugaccaucaugacgggggacaucaagggcaucaugcaggcggggaagcggagccugcgcccgcagcccaccgagcucaaguacuccuggaagaccuggggcaaggccaagaugcugagcaccgagucccacaaccagacguuccugaucgacggccccgagaccgccgagugcccgaacaccaaccgggccuggaacagccucgaggucgaggacuacggguucggcguguucaccacgaacaucuggcugaagcugcgcgagaagcaggacguguucugcgacuccaagcucaugagcgccgcgaucaaggacaaccgggccguccacgccgacaugggguacuggaucgaguccgcccugaacgacaccuggaagauggagaaggccagcuucaucgaggugaaguccugccacuggcccaagagccacacccugugguccaacggcgugcucgagagcgagaugaucauccccaagaacuucgcgggccccgucagccagcacaacuaccgcccgggguaccacacccagaccgccggccccuggcaccuggggaagcuggagauggacuucgacuucugcgagggcacgaccgugguggucaccgaggacugcgggaaccggggccccucccuccgcaccacgaccgccagcggcaagcugaucaccgaguggugcugccgguccugcacccugcccccgcuccgcuaccgcggggaggacggcugcugguacgggauggagauccgcccccugaaggagaaggaggagaaccuggugaacagccucgugacggccggccacgggcagaucgacaacuucucccugggcguccugggcauggcccucuuccuggaggagaugcugcggacccgcguggggaccaagcacgccaugcuccugguggccgucagcuucgugacccugaucacgggcaacauguccuuccgggaccucgggcgcgugauggucauggugggcgccaccaugaccgacgacaucgggaugggcaucaccuaccuggcccugcucgcggccuucaaggugcgccccacguucgccgccggccugcugcuccggaagcugaccagcaaggagcugaugauggccaccaucgggaucgcgcuccugucccagagcaccauccccgagacgauccuggagcucaccgacgcccuggcccugggcaugaugguccucaagaucgugcgcaacauggagaaguaccagcuggccgugaccaucauggccaucuccugcgucccgaacgcggugauccugcagaacgccuggaaggugagcugcaccauccucgccgccgucuccgugagcccccugcugcucacguccagccagcagaaggcggacuggaucccccuggcccugaccaucaaggggcucaaccccaccgccaucuuccugaccacgcugucccggaccagcaagaagcgcuccuggccgcucaacgaggccaucauggccgucggcauggugagcauccuggcgagcucccugcucaagaacgacauccccaugaccggcccccugguggccgggggccugcucaccgucugcuacgugcugacggggcggagcgccgaccuggagcucgagcgcgccgccgacgugaagugggaggaccaggcggagaucuccggcagcucccccauccugagcaucaccaucuccgaggacgggagcauguccaucaagaacgaggaggaggagcagacccugaccauccucauccggacgggccugcuggucaucagcggcguguucccgguguccauccccaucaccgccgccgccugguaccucugggaggucaagaagcagcgcgccggggugcugugggacgugcccagcccgccgcccgucggcaaggcggagcuggaggacggggccuaccggaucaagcagcgcggcauccucggguacucccagaucggcgccggcguguacaaggaggggaccuuccacaccauguggcacgugacccggggcgccguccugaugcaccgcgggaagcggaucgagcccagcugggccgacgugaagaaggaccugaucuccuacggcgggggcuggaagcucgagggcgaguggaaggagggggaggaggugcagguccuggcgcuggagcccggcaagaacccccgcgccgugcagacgaagcccggccucuucaagaccaacaccggcaccaucggggccgugagccuggacuucucccccggcacgagcggcucccccaucgucgaccggaaggggaagguggugggccuguacgggaacggcgucgugacccgcagcggcgccuacgugagcgcgaucgcccagaccgagaaguccaucgaggacaaccccgagaucgaggacgacaucuuccggaagaagcgccucaccaucauggaccugcaccccggggccggcaagacgaagcgguaccugcccgccaucguccgcgaggccaucaagcgggggcugcgcacccucauccuggcgccgacccgcgugguggccgccgagauggaggaggcccugcggggccuccccauccgcuaccagacccccgccauccgggcggagcacacggggcgcgagaucgucgaccugaugugccacgccaccuucaccaugcggcugcucagccccgugcgcgugccgaacuacaaccugaucaucauggacgaggcccacuucaccgaccccgccuccaucgccgcgcggggcuacaucagcacgcgcgucgagaugggcgaggccgccgggaucuucaugaccgccacgccgcccggcucccgggacccguucccccagagcaacgcgcccaucauggacgaggagcgcgagauccccgagcgguccuggaacagcgggcacgagugggugaccgacuucaagggcaagacggugugguucgucccguccaucaaggccgggaacgacaucgccgccugccugcgcaagaacggcaagaaggugauccagcucagccggaagaccuucgacuccgaguacgugaagacccgcgccaacgacugggacuucgucgugaccacggacaucagcgagaugggcgcgaacuucaaggccgagcgggugaucgacccccgccggugcaugaagcccgucauccugaccgacggggaggagcgcgugauccuggccggccccaugccggugacccacuccagcgccgcccagcggcgcgggcgcaucggccggaaccccaagaacgagaacgaccaguacaucuacaugggggagccccucgagaacgacgaggacugcgcgcacuggaaggaggccaagaugcugcuggacaacaucaacacccccgagggcaucaucccguccauguucgagcccgagcgcgagaaggucgacgccaucgacggcgaguaccggcuccgcggggaggcccggaagacguucguggaccugaugcgccggggcgaccugcccguguggcucgccuaccgcgucgcggccgaggggaucaacuacgccgaccggcgcuggugcuucgacggcaucaagaacaaccagauccuggaggagaacguggagguggagaucuggaccaaggagggggagcggaagaagcugaagccgcgcuggcucgacgcccggaucuacagcgacccccuggcgcugaaggaguucaaggaguucgccgccggccgcaagucccucacccugaaccugaucaccgagaugggccggcuccccacguucaugacccagaaggcccgcgacgcccuggacaaccuggcgguccuccacaccgccgaggccgggggccgggccuacaaccacgcccugagcgagcugcccgagacccucgagacgcugcugcuccugacccugcucgcgaccgugaccgggggcaucuuccuguuccugauguccggcaaggggaucggcaagaugacgcucgggaugugcugcaucaucaccgccagcauccugcugugguacgcccagauccagccgcacuggaucgccgccagcaucauccucgaguucuuccugaucguccugcucauccccgagcccgagaagcagcgcacgccccaggacaaccagcugaccuacguggugaucgcgauccugaccgucguggccgccacgauggccaacgagaugggcuuccucgagaagaccaagaaggaccuggggcugggcuccaucgccacccaggagagcgaguccaacauccucgacaucgaccugcggccggcgagcgccuggacccuguacgccguggccacgaccuucgucacccccaugcuccgccacuccaucgagaacagcuccgugaacgugagccugaccgcgaucgccaaccaggccacgguccugaugggccucgggaagggcuggccccuguccaagauggacaucggggugccccugcucgccaucggcugcuacagccaggugaacccgaucacccugaccgccgcgcugcuccugcuggucgcccacuacgccaucaucgggcccggccuccaggccaaggccacccgggaggcgcagaagcgcgccgccgccggcaucaugaagaaccccacgguggacgggaucaccgugaucgaccuggagcccaucccguacgaccccaaguucgagaagcagcugggccaggucaugcuccugauccugugcgugacccaggugcucaugaugcgcaccacgugggcccugugcgaggcgcugacccucgccaccgggcccaucuccacccugugggagggcaaccccgggcgguucuggaacacgaccaucgccgucagcauggccaacaucuuccgcggcuccuaccuggcgggcgccgggcuccuguucagcaucaugaagaacaccaccaacacgcggcgcggcaccgggaacaucggcgagacccugggcgagaaguggaagucccggcucaacgcccugggcaagagcgaguuccagaucuacaagaaguccggcauccaggagguggaccgcacccuggccaaggaggggaucaagcggggcgagacggaccaccacgccgugagccgcggguccgcgaagcuccggugguucgucgagcgcaacauggugaccccggagggcaagguggucgaccugggcugcgggcggggcggguggagcuacuacugcggcgggcugaagaacgugcgcgaggugaagggccucaccaagggcgggcccggccacgaggagcccauccccaugagcaccuacggguggaaccugguccggcugcaguccggcguggacguguucuucacgccgcccgagaagugcgacacccuccugugcgacaucggggagagcucccccaaccccaccaucgaggccggccgcacccugcggguccucaaccugguggagaacuggcugaacaacaacacgcaguucugcaucaaggugcucaacccguacaugcccagcgucaucgagaagauggagacccugcagcgcaaguacggcggggcccuggugcggaacccccugucccgcaacagcacccacgagauguacuggguguccaacgccaccggcaacaucgucagcuccgugaacaugaucagccggaugcucaucaaccgcuucaccaugaagcacaagaaggccacguacgagccggacguggaccugggguccggcacccgcaacaucgggaucgagagcgagauccccaaccuggacaucaucggcaagcggaucgagaagaucaagcaggagcacgagaccuccuggcacuacgaccaggaccaccccuacaagaccugggcguaccacggcagcuacgagacgaagcagaccggguccgccagcuccauggucaacggcguggugcgccuccugaccaagcccugggacgucgugccgauggugacccagauggccaugacggacaccacccccuucgggcagcagcgggucuucaaggagaagguggacacccgcacgcaggagcccaaggagggcaccaagaagcugaugaagaucaccgccgaguggcucuggaaggagcugggcaagaagaagacgccccggaugugcacgcgcgaggaguucacccggaaggugcgcagcaacgccgcgcugggggccaucuucaccgacgagaacaaguggaaguccgcccgggaggccgucgaggacagccgcuucugggagcucaucgaccgggagcgcaaccugcaccuggagggcaagugcgagaccugcguguacaacaugauggggaagcgggagaagaagcucggcgaguucgggaaggcgaagggcagccgcgccaucugguacauguggcugggcgcccgguuccuggaguucgaggcccucggguuccugaacgaggaccacugguucucccgcggcaacagccuguccgggguggagggcgaggggcuccaccggcugggcuacauccugcgcgacgucagcaagaaggagggcggggccauguacgcggacgacacggccggcugggacacccggaucacccucgaggaccugaagaacgaggagauggugaccaaccacaugaagggggagcacaagaagcuggccgaggccaucuucaagcucacguaccagaacaaggucgugcgcgugcagcggccgacgccccggggcaccgucauggacaucaucucccgccgggaccagcgcgggagcggccaggugggcaccuacgggcugaacacguucaccaacauggaggcccagcugauccggcagauggagggcgaggggaucuucaaguccauccagcaccucaccgugaccgaggagaucgcgguccagaacuggcuggcccgcgugggccgggagcgccugagccggauggccaucuccggcgacgacugcguggucaagccccucgacgaccgcuucgccagcgcccugacggcgcugaacgacauggggaaggugcggaaggacauccagcagugggagcccucccgcggcuggaacgacuggacccaggugccguucugcagccaccacuuccacgagcucgucaugaaggacgggcgggugcuggugguccccugccgcaaccaggacgagcugaucggccgggcccgcaucucccagggggccggcuggagccucaaggagaccgccugccugggcaaguccuacgcccagauguggacccugauguacuuccaccggcgcgaccuccggcuggcggccaacgccaucugcagcgccgugcccucccacugggugcccacgagccgcaccaccuggagcauccacgcgaagcacgaguggaugaccaccgaggacaugcuggccgucuggaaccggguguggauccaggagaacccguggauggaggacaagacgcccguggaguccugggaggagguccccuaccucgggaagcgcgaggaccaguggugcggcagccugaucgggcugaccucccgcgccaccugggccaagaacauccagaccgccaucaaccaggugcggagccucaucggcaacgaggaguacacggacuacaugcccuccaugaagcgcuuccggcgcgaggaggaggaggcgggggugcugugguga

SEQ ID NO: 9756 - RNA, 9876 nt, Artificial Sequence
  derived and/or modified CDS sequence (opt1) from DENV-2__GQ398272__SS-prME
accgccggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcagcgagggggccuggaagcacguccagcggaucgagacguggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcugcccgagaaccuggaguacaccaucgugaucacgccccacagcggggaggagcacgccgucggcaacgacaccgggaagcacggcaaggagaucaagaucaccccgcaguccagcaucaccgaggccgagcucaccggguacggcacggugaccauggagugcagcccccggaccggccuggacuucaacgagauggugcugcuccagauggaggacaaggccuggcugguccaccggcagugguuccuggaccucccccugcccuggcugccgggggccgacacccagggcagcaacuggauccagaaggagacgcucgugaccuucaagaacccccacgcgaagaagcaggacguggucgugcuggggucccaggagggcgccaugcacaccgcccugaccggggccacggagauccagaugagcagcggcaaccuccuguucaccggccaccugaagugccgccuccggauggacaagcugcagcugaaggggauguccuacagcaugugcaccggcaaguucaagaucgucaaggagaucgccgagacccagcacgggacgaucgugauccgcgugcaguacgagggcgacggcucccccugcaagauccccuucgagaucauggaccucgagaagcggcacguccuggggcgccugaucaccgugaacccgaucgugaccgagaaggacagccccgucaacaucgaggcggagccgcccuucggcgacuccuacaucaucaucgggguggagccgggccagcucaagcugaacugguucaagaaggggagcuccaucggccagauguucgagaccacgaugcgcggcgccaagcggauggccauccugggggacaccgccugggacuucggcagccucgggggcguguucaccuccaucgggaaggcccugcaccaggucuucggcgcgaucuacggcgccgccuucagcgggguguccuggaccaugaagauccugaucggcgugaucaucacguggaucgggaugaacagccgcuccaccagccuguccgucagccucgugcuggugggcgucgugacccuguaccucggggugaugguccaggccgacuccggcugcguggugagcuggaagaacaaggagcugaagugcggcuccgggaucuucaucaccgacaacguccacacguggaccgagcaguacaaguuccagcccgagagccccagcaagcuggcguccgccauccagaaggcccacgaggagggcaucugcgggauccggagcgugacccgccucgagaaccugauguggaagcagaucacccccgagcugaaccacauccucuccgagaacgaggugaagcugacgaucaugaccggcgacaucaaggggaucaugcaggccggcaagcggagccugcgcccgcagcccaccgagcucaaguacuccuggaagaccuggggcaaggccaagaugcugagcacggagucccacaaccagaccuuccugaucgacgggcccgagaccgcggagugcccgaacaccaaccgggccuggaacagccucgaggucgaggacuacggcuucgggguguucuccacgaacaucuggcugaagcugcgcgagaagcaggacguguucugcgacagcaagcucauguccgccgccaucaaggacaaccgggccguccacgcggacaugggcuacuggaucgagagcgcccugaacgacaccuggaagauggagaaggccuccuucaucgaggucaagagcugccacuggcccaagucccacacccuguggagcaacggcgugcucgaguccgagaugaucauccccaagaacuucgccgggcccgugagccagcacaacuaccgcccgggcuaccacacccagaccgccgggcccuggcaccugggcaagcuggagauggacuucgacuucugcgaggggacgaccgugguggucaccgaggacugcggcaaccggggccccagccuccgcaccacgaccgcguccgggaagcugaucaccgaguggugcugccggagcugcacccugcccccgcuccgcuaccggggcgaggacgggugcugguacggcauggagauccgcccccugaaggagaaggaggagaaccuggugaacucccucgugacggccgggcacggccagaucgacaacuucagccugggcguccuggggauggcccucuuccuggaggagaugcugcggacccgcgugggcaccaagcacgccauccuccugguggcggucuccuucgugacccugaucacggggaacaugagcuuccgggaccucggccgcgugauggucauggugggggccaccaugaccgacgacaucggcaugggcgugaccuaccuggcccugcucgccgccuucaagguccgccccacguucgcggccgggcugcugcuccggaagcugaccuccaaggagcugaugauggccaccaucggcaucgcccuccugagccaguccaccauccccgagacgauccuggagcucaccgacgcccuggcgcuggggaugauggugcucaagaucgugcgcaacauggagaaguaccagcuggccgucaccaucauggccaucagcugcgugccgaacgccgugauccugcagaacgccuggaaggucuccugcaccauccucgcggccgugagcgucagcccccugcugcucacgagcucccagcagaaggccgacuggaucccccuggcccugaccaucaagggccucaaccccaccgcgaucuuccugaccacgcugagccggaccuccaagaagcgcagcuggccgcucaacgaggccgugauggccgugggcauggucuccauccuggccagcagccugcucaagaacgacauccccaugaccgggccccugguggccggcgggcugcucaccgugugcuacguccugacgggccgguccgcggaccuggagcucgagcgcgccgccgacgugaagugggaggaccaggccgagaucagcggguccagccccauccuguccaucaccaucagcgaggacggcuccaugagcaucaagaacgaggaggaggagcagacccugaccauccucauccggacgggccugcuggugaucuccggggucuucccggugagcauccccaucaccgccgcggccugguaccucugggaggugaagaagcagcgcgccggcguccugugggacgugcccagcccgccgcccguggggaaggccgagcuggaggacggcgccuaccggaucaagcagcgcgggaucuucggcuacagccagaucggcgcgggggucuacaaggagggcaccuuccacaccauguggcacgugacccgcggggccgugcucaugcaccgcggcaagcggaucgagcccuccugggccgacgucaagaaggaccugaucagcuacgggggcggcuggaagcuggagggggaguggaaggagggcgaggagguccaggugcucgcccuggagcccgggaagaacccccgcgccguccagacgaagcccggccuguucaagaccaacaccgggaccaucggcgcggugucccucgacuucagccccggcacguccgggagccccaucguggaccggaagggcaaggucguggggcuguacggcaacggcguggucacccgcuccggggccuacgugagcgccaucgcccagaccgagaaguccaucgaggacaaccccgagaucgaggacgacaucuuccggaagaagcgccugaccaucauggaccuccaccccggcgcggggaagacgaagcgguaccugcccgccaucgugcgcgaggccaucaagcggggccugcgcacccugauccucgccccgacccgcgucguggccgcggagauggaggaggcccugcgggggcugcccauccgcuaccagacccccgccauccgggccgagcacacgggccgcgagaucguggaccucaugugccacgccaccuucaccaugcggcugcugucccccguccgcgugccgaacuacaaccucaucaucauggacgaggcgcacuucaccgaccccgccagcaucgccgcccggggcuacaucuccacgcgcguggagaugggggaggccgcgggcaucuucaugaccgccacgccgcccgggagccgggacccguucccccaguccaacgcccccaucauggacgaggagcgcgagauccccgagcggagcuggaacuccggccacgagugggucaccgacuucaaggggaagacggugugguucgugccgagcaucaaggccggcaacgacaucgcggccugccugcgcaagaacggcaagaaggucauccagcugucccggaagaccuucgacagcgaguacgugaagacccgcgccaacgacugggacuucguggucaccacggacaucuccgagaugggggccaacuuccgggccgagcgcgugaucgacccccggcgcugcaugaagcccgugauccucaccgacggcgaggagcgggucauccuggcggggcccaugccggugacccacagcuccgccgcccagcgccgcggccggaucgggcgcaaccccaagaacgagaacgaccaguacaucuacaugggcgagccccuggagaacgacgaggacugcgcccacuggaaggaggccaagaugcuccuggacaacaucaacacccccgagggcaucaucccgagcauguucgagcccgagcgggagaagguggacgcgaucgacggggaguaccgccugcggggcgaggcccgcaagacguucgucgaccucaugcggcgcggggaccugcccguguggcuggccuaccggguggccgccgagggcaucaacuacgcggaccgccgguggugcuucgacgggaucaagaacaaccagauccucgaggagaacgucgagguggagaucuggaccaaggagggcgagcgcaagaagcugaagccgcgguggcuggacgcccgcaucuacuccgacccccucgcccugaaggaguucaaggaguucgccgcgggccggaagucccugacccucaaccugaucaccgagauggggcgccugcccacguucaugacccagaaggcccgggacgcccucgacaaccuggccguccugcacaccgccgaggugggcgggcgcgcguacaaccacgcccucuccgagcugcccgagacccuggagacgcuccugcugcucacccugcuggccaccgugaccggcggcaucuuccucuuccugaugagcgggaagggcaucgggaagaugacgcugggcaugugcugcaucaucaccgccuccauccuccugugguacgcccagauccagccgcacuggaucgcggccagcaucauccuggaguucuuccucaucguccugcugauccccgagcccgagaagcagcggacgccccaggacaaccagcucaccuacguggugaucgccauccugaccgucguggccgccacgauggcgaacgagaugggguuccuggagaagaccaagaaggaccucggccugggcagcaucaucacccaggaguccgagagcaacauccuggacaucgaccuccgcccggccuccgccuggacccuguacgccguggccacgaccuucgucacccccaugcugcggcacagcaucgagaacuccagcgugaacgugucccucaccgcgaucgccaaccaggccacgguccugauggggcugggccgcggguggccccucagcaagauggacaucggcgugccccugcuggccaucgggugcuacucccaggugaacccgaucacccucaucgcggcccugcugcuccuggucgcccacuacgccaucaucggccccggccugcaggccaaggcgacccgcgaggcccagaagcgggccgccgccgggaucaugaagaaccccaccguggacggcaucacggugaucgaccucgagcccaucccguacgaccccaaguucgagaagcagcuggggcaggucaugcugcucgugcugugcgugacccagguccugaugaugcgcaccaccugggcgcucugcgaggcccugacgcuggccaccggccccaucagcacccucugggaggggaaccccggccgguucuggaacaccacgaucgccguguccauggccaacaucuuccgcggcagcuaccuggcgggggccggccuccucuucuccaucaugaagaacaccaccaacacccggcgcgggacgggcaacaucggcgagacccugggggagaaguggaagucccggcugaacgcccucggcaaguccgaguuccagaucuacaagaaguccgggauccaggagguggaccgcacccuggccaaggagggcaucaagcgcggggagaccgaccaccacgcggucucccgcggcagcgccaagcugcggugguucguggagcgcaacauggugacgccggagggcaaggucguggaccucgggugcggccgcggcgggugguccuacuacugcggcgggcugaagaacgugcgcgaggucaaggggcugaccaagggcgggcccgggcacgaggagcccauccccaugagcaccuacggcuggaaccucgugcggcugcagagcgggguggacgucuucuucaccccgcccgagaagugcgacacgcugcucugcgacaucggcgaguccagccccaaccccaccaucgaggccggccgcacccugcgggugcugaaccucguggagaacuggcugaacaacaacacccaguucugcaucaagguccugaacccguacaugcccuccgugaucgagaagauggagacgcuccagcgcaaguacgggggcgcccuggugcggaacccccugagccgcaacuccacccacgagauguacugggucagcaacgccaccgggaacaucguguccagcgugaacaugaucucccgcaugcugaucaaccgguucaccaugaagcacaagaaggcgaccuacgagccggacgucgaccucggcagcgggacgcgcaacaucggcaucgagaacgagauccccaaccuggacaucaucggcaagcggaucgagaagaucaagcaggagcacgagaccuccuggcacuacgaccaggaccaccccuacaagaccugggccuaccacgggagcuacgagaccaagcagacgggcuccgccagcuccauggugaacggggugguccgccugcucaccaagcccugggacguggugccgauggucacccagauggccaugaccgacacgacccccuucggccagcagcggguguucaaggagaagguggacacccgcacccaggagcccaaggagggcacgaagaagcugaugcggaucaccgccgaguggcuguggaaggagcucgggaagaagaagacgccccggaugugcacccgggaggaguucacgcgcaagguccggagcaacgcggcccugggcgccaucuucaccgacgagaacaaguggaaguccgcccgcgaggccguggaggacagccgguucugggagcuggucgaccgcgagcggaaccuccaccuggaggggaagugcgagaccugcguguacaacaugaugggcaagcgcgagaagaagcugggggaguucggcaaggcgaagggcucccgggccaucugguacauguggcucggggcccgcuuccuggaguucgaggcccugggcuuccucaacgaggaccacugguucagccgggggaacagccuguccggcguggagggggagggccugcacaagcucggcuacauccugcgcgacgucagcaagaaggagggcggcgcgauguacgccgacgacaccgccgggugggacacgcggaucacccuggaggaccucaagaacgaggagauggugaccaaccacaugaagggcgagcacaagaagcuggccgaggccaucuucaagcugaccuaccagaacaaggugguccgcgugcagcgcccgacgccccgggggaccgugauggacaucaucucccgcaaggaccagcggggcagcggccaggucgggaccuacggccucaacaccuucacgaacauggaggcgcagcugauccgccagauggagggggagggcaucuucaaguccauccagcaccugaccgugaccgaggagaucgccgugcagaacuggcucgcccgggucggccgcgagcggcugagccgcauggccaucuccggggacgacugcguggugaagccccuggacgaccgguucgccagcgcgcucaccgcccugaacgacaugggcaagguccgcaaggacauccagcagugggagcccucccggggguggaacgacuggacccaggugccguucugcagccaccacuuccacgagcuggugaugaaggacggccgcguccucguggugcccugccggaaccaggacgagcugaucgggcgcgcccggaucucccagggcgccggcuggagccugaaggagaccgccugccucgggaaguccuacgcgcagauguggacccugauguacuuccaccgccgggaccugcgccucgccgccaacgccaucugcagcgccguccccucccacugggugcccaccagccggacgaccugguccauccacgcgaagcacgaguggaugaccaccgaggacaugcuggccguguggaaccgcgucuggauccaggagaacccguggauggaggacaagacccccguggagagcugggaggaggugcccuaccugggcaagcgcgaggaccaguggugcgggagccucaucggccugacgucccgggccaccugggccaagaacauccagaccgcgaucaaccagguccgcagccugaucgggaacgaggaguacaccgacuacaugcccuccaugaagcgguuccgcaaggaggaggaggaggccggcgugcucugguga

SEQ ID NO: 9757 - RNA, 9876 nt, Artificial Sequence
  derived and/or modified CDS sequence (opt1) from DENV-2__GQ398292__SS-prME
accgccggcgucuucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccggaccgagaccuggaugagcagcgagggggccuggaagcacguccagcggaucgagaccuggaucaugcgccacccgggcuucaccaucauggccgcgauccuggccuacaccaucgggaccacccacuuccagcgggcccugaucuucauccuccugaccgccguggcgcccagcaugaccaugcgcugcaucggcaucuccaaccgggacuucguggagggcgucagcgggggcuccuggguggacaucgugcuggagcacgggagcugcgucaccacgauggccaagaacaagcccacccucgacuucgagcugaucaagaccgaggccaagcagcccgccacccugcgcaaguacugcaucgaggccaagcucacgaacaccaccaccgagucccggugcccgacgcagggcgagcccagccugaacgaggagcaggacaagcgcuucgugugcaagcacuccaugguggaccggggcugggggaacggcugcgggcuguucggcaagggcgggaucgugaccugcgcgauguucacgugcaagaagaacauggagggcaagguggugcuccccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccugcuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucauggaccuggagaagcggcacgugcucgggcgccugaucaccgugaacccgaucgucgcggagaaggacagccccgugaacaucgaggccgagccgcccuucggcgacuccuacaucaucaucgggguggagccgggccagcugaagcucaacugguucaagaaggggagcuccaucggccagauguucgagaccaccaugcgcggcgccaagcggauggccauccugggggacacggccugggacuucggcagccucggcggggucuucaccuccaucgggaaggcgcuccaccagguguucggggccaucuacggcgccgccuucagcgggguguccuggaccaugaagauccugaucggcgucaucaucaccuggaucgggaugaacagccgcuccacgagccuguccgugagccuggugcucgucggcguggugacccuguaccugggggcgaugguccaggccgacuccggcugcguggugagcuggaaguccaaggagcucaagugcggcagcgggaucuucaucaccgacaacguccacaccuggacggagcaguacaaguuccagcccgagagccccuccaagcuggccagcgccauccagaaggcccacgaggagggcaucugcgggauccgguccgugacccgccuggagaaccucauguggaagcagaucacccccgagcugaaccacauccugagcgagaacgaggugaagcucaccaucaugacgggcgacaucaaggggaucaugcaggcgggcaagcggucccugcgcccgcagcccaccgagcugaaguacagcuggaagaccuggggcaaggccaagaugcucuccaccgagagccacaaccagacguuccugaucgacgggcccgagaccgccgagugcccgaacaccaaccgggccuggaacucccuggaggucgaggacuacggcuucgggguguucaccacgaacaucuggcucaagcugcgcgagaagcaggacguguucugcgacagcaagcugauguccgccgcgaucaaggacaaccgggccguccacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgcggggcccgugagccagcacaacuaccgcccgggcuaccacacccagaccgccgggcccuggcaccucggcaagcuggagauggacuucgacuucugcgaggggacgaccgugguggucaccgaggacugcggcaaccggggccccagccugcgcaccacgaccgccuccgggaagcucaucaccgaguggugcugccggagcugcacccugcccccgcugcgcuaccggggcgaggacgggugcugguacggcauggagauccgcccccucaaggagaaggaggagaaccuggugaacucccuggugacggccgggcacggccagaucgacaacuucagccucggcguccuggggauggcgcuguuccucgaggagaugcugcggacccgcgugggcaccaagcacgccaugcugcucguggccgucuccuucgugacccugaucacggggaacaugagcuuccgggaccugggccgcgugauggucauggugggggccaccaugaccgacgacaucggcaugggcaucaccuaccucgcccugcuggcggccuucaaggugcgccccacguucgccgccgggcuccugcugcggaagcucaccuccaaggagcugaugauggccaccaucggcaucgcgcugcucagccaguccaccauccccgagacgauccuggagcugaccgacgcccucgcccuggggaugaugguccugaagaucgugcgcaacauggagaaguaccagcucgccgugaccaucauggccaucagcugcgucccgaacgcggugauccugcagaacgccuggaagguguccugcaccauccuggccgccgucagcgugagcccccugcugcugacgagcucccagcagaaggcggacuggaucccccucgcccugaccaucaagggccugaaccccaccgccaucuuccucaccacgcugagccggaccuccaagaagcgcagcuggccgcugaacgaggccaucauggccgucggcaugguguccauccucgcgagcagccugcugaagaacgacauccccaugaccgggccccucguggccggcgggcugcugaccgucugcuacgugcucacgggccgguccgccgaccuggagcuggagcgcgccgccgacgugaagugggaggaccaggcggagaucagcggguccagccccauccucuccaucaccaucagcgaggacggcuccaugagcaucaagaacgaggaggaggagcagacccugaccauccugauccggacgggccuccuggucaucuccgggguguucccggugagcauccccaucaccgccgccgccugguaccugugggaggucaagaagcagcgcgccggcgugcucugggacgugcccagcccgccgcccgucgggaaggcggagcuggaggacggcgccuaccggaucaagcagcgcgggauccugggcuacagccagaucggcgccgggguguacaaggagggcaccuuccacaccauguggcacgugacccgcggggccguccucaugcaccgcggcaagcggaucgagcccuccugggccgacgugaagaaggaccugaucagcuacgggggcggcuggaagcuggagggggaguggaaggagggcgaggaggugcagguccucgcgcuggagcccgggaagaacccccgcgccgugcagacgaagcccggccuguucaagaccaacaccgggaccaucggcgccgugucccucgacuucagccccggcacguccgggagccccaucgucgaccggaagggcaaggugguggggcuguacggcaacggcgucgugacccgcuccggggccuacgugagcgcgaucgcccagaccgagaaguccaucgaggacaaccccgagaucgaggacgacaucuuccggaagaagcgccugaccaucauggaccuccaccccggcgccgggaagacgaagcgguaccugcccgccaucguccgcgaggccaucaagcggggccugcgcacccugauccucgcgccgacccgcgugguggccgccgagauggaggaggcccugcgggggcugcccauccgcuaccagacccccgccauccgggcggagcacacgggccgcgagaucgucgaccucaugugccacgccaccuucaccaugcggcugcugucccccgugcgcgugccgaacuacaaccucaucaucauggacgaggcccacuucaccgaccccgccagcaucgccgcgcggggcuacaucuccacgcgcgucgagaugggggaggccgccggcaucuucaugaccgccacgccgcccgggagccgggacccguucccccaguccaacgcgcccaucauggacgaggagcgcgagauccccgagcggagcuggaacuccggccacgagugggugaccgacuucaaggggaagacggugugguucgucccgagcaucaaggccggcaacgacaucgccgccugccugcgcaagaacggcaagaaggugauccagcugucccggaagaccuucgacagcgaguacgugaagacccgcgccaacgacugggacuucgucgugaccacggacaucuccgagaugggggcgaacuucaaggccgagcgggugaucgacccccgccggugcaugaagcccgucauccucaccgacggcgaggagcgcgugauccuggccgggcccaugccggugacccacagcuccgccgcccagcggcgcggccgcaucgggcggaaccccaagaacgagaacgaccaguacaucuacaugggcgagccccuggagaacgacgaggacugcgcgcacuggaaggaggccaagaugcuccuggacaacaucaacacccccgagggcaucaucccgagcauguucgagcccgagcgcgagaaggucgacgccaucgacggggaguaccggcugcgcggcgaggcccggaagacguucguggaccucaugcgccgcggggaccugcccguguggcuggccuaccgcgucgcggccgagggcaucaacuacgccgaccggcgcuggugcuucgacgggaucaagaacaaccagauccucgaggagaacguggagguggagaucuggaccaaggagggcgagcggaagaagcugaagccgcgcuggcuggacgcccggaucuacuccgacccccucgcgcugaaggaguucaaggaguucgccgccggccgcaagagccugacccucaaccugaucaccgagauggggcggcugcccacguucaugacccagaaggcccgcgacgcccucgacaaccuggcgguccugcacaccgccgaggccggcgggcgggccuacaaccacgcccucuccgagcugcccgagacccuggagacgcuccugcugcucacccugcuggcgaccgugaccggcggcaucuuccucuuccugaugagcgggaagggcaucgggaagaugacgcugggcaugugcugcaucaucaccgccuccauccuccugugguacgcccagauccagccgcacuggaucgccgccagcaucauccuggaguucuuccucaucguccugcugauccccgagcccgagaagcagcgcacgccccaggacaaccagcucaccuacguggugaucgcgauccugaccgucguggccgccacgauggccaacgagaugggguuccuggagaagaccaagaaggaccucggccugggcagcaucgccacccaggaguccgagagcaacauccuggacaucgaccuccggccggcguccgccuggacccuguacgccguggccacgaccuucgucacccccaugcugcgccacagcaucgagaacuccagcgugaacgugucccucaccgcgaucgccaaccaggccacgguccugauggggcugggcaagggguggccccucagcaagauggacaucggcgugccccugcuggccaucgggugcuacucccaggugaacccgaucacccucaccgccgcgcugcugcuccuggucgcccacuacgccaucaucggccccggccugcaggccaaggccacccgggaggcgcagaagcgcgccgccgccgggaucaugaagaaccccacgguggacggcaucaccgugaucgaccucgagcccaucccguacgaccccaaguucgagaagcagcuggggcaggucaugcugcucauccugugcgugacccaggugcugaugaugcgcaccacgugggcccucugcgaggcgcugacccuggccaccggccccaucagcacccucugggaggggaaccccggccgguucuggaacacgaccaucgccgucuccauggccaacaucuuccgcggcagcuaccuggcgggggccggccuccucuucuccaucaugaagaacaccaccaacacgcggcgcgggaccggcaacaucggcgagacccugggggagaaguggaagucccggcugaacgcccucggcaaguccgaguuccagaucuacaagaaguccgggauccaggagguggaccgcacccuggccaaggagggcaucaagcgcggggagacggaccaccacgccgugucccgcggcagcgcgaagcugcggugguucgucgagcgcaacauggugaccccggagggcaagguggucgaccucgggugcggccgcggcgggugguccuacuacugcggcgggcugaagaacgugcgcgaggugaaggggcugaccaagggcggccccgggcacgaggagcccauccccaugagcaccuacggcuggaaccucguccggcugcagagcgggguggacguguucuucacgccgcccgagaagugcgacacccugcucugcgacaucggcgaguccagccccaaccccaccaucgaggccggccgcacccugcggguccugaaccucguggagaacuggcugaacaacaacacgcaguucugcaucaaggugcugaacccguacaugcccuccgucaucgagaagauggagacccuccagcgcaaguacgggggcgcccuggugcggaacccccugagccgcaacuccacccacgagauguacugggugagcaacgccaccgggaacaucgucuccagcgugaacaugaucucccggaugcugaucaaccgcuucaccaugaagcacaagaaggccacguacgagccggacguggaccucggcagcgggacccgcaacaucggcaucgaguccgagauccccaaccuggacaucaucggcaagcggaucgagaagaucaagcaggagcacgagaccagcuggcacuacgaccaggaccaccccuacaagaccugggcguaccacggguccuacgagacgaagcagaccggcagcgccuccagcauggucaacgggguggugcgccugcucaccaagcccugggacgucgugccgauggugacccagauggccaugacggacaccacccccuucggccagcagcgggucuucaaggagaagguggacacccgcacgcaggagcccaaggagggcaccaagaagcugaugaagaucaccgccgaguggcuguggaaggagcucgggaagaagaagacgccccggaugugcacgcgcgaggaguucacccggaaggugcgcuccaacgccgcgcugggcgccaucuucaccgacgagaacaaguggaaguccgcccgggaggccgucgaggacucccgcuucugggagcugaucgaccgggagcgcaaccuccaccuggaggggaagugcgagaccugcguguacaacaugaugggcaagcgggagaagaagcugggggaguucggcaaggcgaagggcagccgcgccaucugguacauguggcucggggcccgguuccuggaguucgaggcccugggcuuccucaacgaggaccacugguucagccgcgggaacucccugagcggcguggagggggagggccugcaccggcucggcuacauccugcgcgacgucuccaagaaggagggcggcgccauguacgcggacgacacggccgggugggacacccggaucacccuggaggaccucaagaacgaggagauggugaccaaccacaugaagggcgagcacaagaagcuggccgaggccaucuucaagcugacguaccagaacaaggucgugcgcgugcagcggccgacgccccgggggaccgucauggacaucaucagccgccgggaccagcgcggcuccggccagguggggaccuacggccucaacacguucaccaacauggaggcccagcugauccggcagauggagggggagggcaucuucaagagcauccagcaccugaccgugaccgaggagaucgcgguccagaacuggcucgcccgcgugggccgggagcgccugucccggauggccaucagcggggacgacugcguggucaagccccuggacgaccgcuucgccuccgcccucacggcgcugaacgacaugggcaaggugcggaaggacauccagcagugggagcccagccgcggguggaacgacuggacccaggugccguucugcucccaccacuuccacgagcuggucaugaaggacggccgggugcucgugguccccugccgcaaccaggacgagcugaucgggcgggcccgcaucagccagggcgccggcuggucccugaaggagaccgccugccucggcaagagcuacgcccagauguggacccugauguacuuccaccggcgcgaccugcggcucgcggccaacgccaucugcuccgccgugcccagccacugggugcccacgucccgcaccaccuggagcauccacgcgaagcacgaguggaugaccaccgaggacaugcuggccgucuggaaccggguguggauccaggagaacccguggauggaggacaagacgcccguggagagcugggaggagguccccuaccugggcaagcgcgaggaccaguggugcgggucccucaucggccugaccagccgcgccaccugggccaagaacauccagaccgccaucaaccaggugcggucccugaucgggaacgaggaguacacggacuacaugcccagcaugaagcgcuuccggcgcgaggaggaggaggcgggcgugcucugguga

SEQ ID NO: 9758 - RNA, 9876 nt, Artificial Sequence
  derived and/or modified CDS sequence (opt1) from DENV-2__GQ398267__SS-prME
accgccgggaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgugauggugcaggcggacuccgggugcgucgugagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgucacccgccuggagaaccugauguggaagcagaucacccccgagcucaaccacauccugaccgagaacgaggugaagcugacgaucaugaccggggacaucaagggcaucaugcaggccgggaagcggucccuccgcccgcagcccaccgagcugaaguacagcuggaaggcguggggcaaggccaagaugcuguccaccgagcuccacaaccacacguuccugaucgacggccccgagaccgccgagugcccgaacaccaaccgggccuggaacagccuggagguggaggacuacggguucggcgucuucaccacgaacaucuggcucaagcugaaggagcgccaggacguguucugcgacuccaagcugaugagcgccgcgaucaaggacaaccgggccgugcacgccgacaugggguacuggaucgaguccgcccucaacgacaccuggaagaucgagaaggccagcuucaucgaggucaaguccugccacuggcccaagagccacacccugugguccaacggcgugcuggagagcgagaugaucauccccaagaacuucgcgggccccgugucccagcacaacuaccgcccgggguaccacacccagaccgccggccccuggcaccucgggcggcuggagauggacuucgacuucugcgagggcacgaccgucguggugaccgaggacugcgggaaccgcggccccagccugcggaccacgaccgccagcggcaagcucaucaccgaguggugcugccgcuccugcacccugcccccgcugcgguaccgcggggaggacggcugcugguacgggauggagauccggccccucaaggagaaggaggagaaccuggucaacagccuggugacggccggccacgggcagaucgacaacuucucccucggcgugcugggcauggcgcuguuccucgaggagaugcugcgcacccgggucgggaccaagcacgccauccugcucguggccgugagcuucgucacccugaucacgggcaacauguccuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccagcaaggagcugaugaugaccaccaucgggaucguccugcucucccagagcacgauccccgaguccauccuggagcugaccgacgcccucgcgcugggcaugauggugcugaagaucguccggaacauggagaaguaccagcucgccgugaccaucauggccauccugugcgugccgaacgccgucauccugcagaacgccuggaaggugagcugcaccacgcucgcgguggucuccgugagcccccugcugcucaccuccagccagcagaaggccgacuggaucccccuggcccugaccaucaaggggcucaaccccaccgccaucuuccugacgacccugucccgcaccagcaagaagcgguccuggccgcucaacgaggcgaucauggccgugggcauggucagcauccuggccuccagccugcucaagaacgacauccccaugaccggcccccugguggccgggggccugcucacggugugcuacguccugaccgggcgcagcgccgaccuggagcucgagcgggcggccgacgugcgcugggaggagcaggccgagaucuccggcagcucccccauccugagcaucaccaucuccgaggacgggagcauguccaucaagaacgaggaggaggagcagacccugacgauccucauccggaccggccugcuggugaucagcggccucuucccggucuccauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacucccagaucggcgccggcguguacaaggaggggaccuuccacaccauguggcacgucacgcgcggcgcggugcugaugcacaaggggaagcggaucgagcccagcugggccgacgugaagaaggaccucaucuccuacggcgggggcuggaagcuggagggcgaguggaaggagggggaggagguccaggugcuggcccucgagcccggcaagaacccccgcgccgugcagaccaagcccgggcuguucaagaccaacaccggcacgaucggggccgucagccuggacuucucccccggcaccagcggcucccccaucguggacaagaaggggaagguggucggccucuacgggaacggcguggugacccggagcggcaccuacgucuccgcgaucgcccagacggagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcguggucgccgccgagauggaggaggcccuccgcggccugcccauccgguaccagacccccgcgauccgcgccgagcacaccgggcgggagaucguggaccugaugugccacgccaccuucacgaugcgccuccugagccccauccgggugccgaacuacaaccugaucaucauggacgaggcccacuucaccgaccccgccuccaucgcggcccgcggcuacaucagcacccgggucgagaugggcgaggccgccgggaucuucaugaccgccacgccgcccggcucccgcgacccguucccccagagcaacgcgcccaucauggacgaggagcgggagauccccgagcgcuccuggaacagcgggcacgagugggugaccgacuucaagggcaagaccgugugguucgucccguccaucaaggccgggaacgacaucgccgccugccuccggaagaacggcaagaaggugauccagcugagccgcaagaccuucgacuccgaguacaucaagacgcggaccaacgacugggacuucguggucaccaccgacaucagcgagaugggcgcgaacuucaaggccgagcgcgugaucgacccccggcgcugcaugaagcccgugauccugacggacggggaggagcgggucauccucgccggccccaugccggugacccacuccagcgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgggagaaggucgacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgugaagaacaaccagauccuggaggagaacgucgagguggagaucuggacgaaggagggggagcgcaagaagcucaagccgcgguggcuggacgcccgcaucuacagcgacccccuggcccucaaggaguucaaggaguucgcggccggccggaagucccugacccugaaccucaucaccgagaugggccgccugcccaccuucaugacgcagaaggccaagaacgcccuggacaaccucgcggugcugcacaccgccgaggccgggggccgggccuacaaccacgcccugagcgagcuccccgagacccuggagacccugcuccugcugacgcuccuggcgaccgucaccgggggcaucuuccuguuccucauguccggcaaggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugaccuacguggucaucgcgauccucaccgugguggccgccaccauggccaacgagaugggcuuccuggagaagacgaagaaggacuucgggcugggcagcaucaccacccagcagccggagagcaacauccucgacaucgaccugcggcccgccuccgcguggacccuguacgccgucgccacgaccuucaucacccccaugcuccgccacagcaucgagaacuccagcgugaacgugucccugaccgccaucgccaaccaggcgacgguccugaugggccucgggaagggcuggccccugagcaagauggacaucggggugccgcugcucgccaucggcugcuacucccaggugaaccccaucacccugaucgccgcccugcuccugcuggucgcgcacuacgccaucaucgggcccggccuccaggccaaggccacccgggaggcccagaagcgcgcggccgccggcaucaugaagaaccccaccguggacgggaugacggugaucgaccuggacccgauccccuacgaccccaaguucgagaagcagcugggccaggucaugcuccuggugcugugcgugacccagguccucaugaugcggaccaccugggcccugugcgaggcccugacgcucgcgaccgggcccaucagcacccugugggagggcaacccggggcgcuucuggaacaccacgaucgccguguccauggccaacaucuuccgcggcagcuaccuggccggcgccgggcuccuguucuccaucaugaagaacaccgcgaacacccggcgcggcaccgggaacaucggcgagacgcugggcgagaaguggaagaaccggcucaacgcccugggcaagagcgaguuccagaucuacaagaaguccggcauccaggagguggaccgcacccuggccaaggaggggaucaagcggggcgagaccgaccaccacgccgucagccgcggguccgcgaagcuccggugguucguggagcgcaaccuggugacccccgagggcaaggucguggaccugggcugcgggcggggcggguggagcuacuacugcggcgggcucaagaacgugaaggaggucaagggccugacgaagggcgggcccggccacgaggagcccaucccgauguccaccuacggguggaaccuggugcgccuccagagcggcguggacgucuucuucacgccgcccgagaagugcgacacccugcugugcgacaucggggaguccagccccaacccgacgguggaggccggccggacccuccgcgugcugaaccuggucgagaacuggcucaacaacaacacccaguucugcaucaaggugcugaaccccuacaugcccagcgugaucgagaagauggaggcccugcagcggaaguacggcggggcccugguccgcaacccgcucucccggaacagcacccacgagauguacuggguguccaacgccagcggcaacaucguguccagcgucaacaugaucucccgcaugcugaucaaccgguucaccaugcgccacaagaaggcgacguacgagcccgacguggaccuggggagcggcacccggaacaucgggaucgaguccgagacccccaaccucgacaucaucggcaagcgcaucgagaagaucaagcaggagcacgagaccagcuggcacuacgaccaggaccaccccuacaagacgugggccuaccacggcuccuacgagaccaagcagaccgggagcgccuccagcauggugaacggcgucgugcgccugcugaccaagccgugggacgugauccccauggucacgcagauggccaugaccgacaccacccccuucgggcagcagcggguguucaaggagaaggucgacacgcgcacccaggagcccaaggagggcaccaagaagcucaugaagaucaccgccgaguggcuguggaaggagcugggcaagaagaagacgccgcggaugugcacccgcgaggaguucacccggaaggugcgcuccaacgcggcccucggggccaucuucaccgacgagaacaaguggaaguccgcccgggaggccguggaggacuccggcuucugggagcuggucgacaaggagcgcaaccugcaccucgaggggaagugcgagacgugcguguacaacaugaugggcaagcgggagaagaagcugggggaguucggcaaggcgaagggcagccgcgccaucugguacauguggcugggggcccgguuccucgaguucgaggcccugggcuuccugaacgaggaccacugguucucccgcgagaacagccucagcgggguggagggcgaggggcugcacaagcugggcuacauccuccgggacgucuccaagaaggagggcggggcgauguacgccgacgacaccgccggcugggacacccgcaucacccuggaggaccugaagaacgaggagauggugacgaaccacauggagggggagcacaagaagcucgccgaggccaucuucaagcugaccuaccagaacaaggugguccgggugcagcgccccacgccccggggcaccgugauggacaucaucagccgccgggaccagcgcggguccggccaggucgugacguacggccugaacaccuucaccaacauggaggcgcagcucauccggcagauggagggggagggcguguucaagagcauccagcagcugaccgucaaggaggagaucgccgugaagaacuggcugauccgcguggggcgcgagcggcucucccgcauggccaucagcggcgacgacugcgucgugaagccccuggacgaccgguucgccuccgcccugaucgcgcucaacgacaugggcaaggugcgcaaggacauccagcagugggagccgagccggggguggaacgacuggacgcagguccccuucugcucccaccacuuccacgagcugaucaugaaggacggccgcgugcuggugguccccugccggaaccaggacgagcucaucgggcgcgcccggaucagccagggcgccggguggucccugcgcgagaccgccugccugggcaagagcuacgcccagauguggucccucauguacuuccaccggcgcgaccugcggcuggcggccaacgccaucugcagcgccgugcccucccacugggugccgaccagccgcaccacgugguccauccacgccacccacgaguggaugaccaccgaggacaugcucaccgucuggaaccggguguggauccaggagaaccccuggauggaggacaagacgcccguggagagcugggaggagauccccuaccugggcaagcgcgaggaccaguggugcgggagccugaucggccucaccucccgggcgaccugggccaagaacauccagaccgccaucaaccagguccgcagccugaucgggaacgaggaguacacggacuacaugccguccaugaagcgguuccgccgcgaggaggaggaggccggcgugcugugguga

SEQ ID NO: 9759 - RNA, 9876 nt, Artificial Sequence
  derived and/or modified CDS sequence (opt1) from DENV-2__GQ398266__SS-prME
accgccggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgugauggugcaggcggacuccgggugcgucgugagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgucacccgccuggagaaccugauguggaagcagaucacccccgagcucaaccacauccugaccgagaacgaggugaagcugacgaucaugaccggggacaucaagggcaucaugcaggccgggaagcggucccuccgcccgcagcccaccgagcugaaguacagcuggaaggcguggggcaaggccaagaugcuguccaccgagcuccacaaccacacguuccugaucgacggccccgagaccgccgagugcccgaacaccaaccgggccuggaacagccuggagguggaggacuacggguucggcgucuucaccacgaacaucuggcucaagcugaaggagcgccaggacguguucugcgacuccaagcugaugagcgccgcgaucaaggacaaccgggccgugcacgccgacaugggguacuggaucgaguccgcccucaacgacaccuggaagaucgagaaggccagcuucaucgaggucaaguccugccacuggcccaagagccacacccugugguccaacggcgugcuggagagcgagaugaucauccccaagaacuucgcgggccccgugucccagcacaacuaccgcccgggguaccacacccagaccgccggccccuggcaccucgggcggcuggagauggacuucgacuucugcgagggcacgaccgucguggugaccgaggacugcgggaaccgcggccccagccugcggaccacgaccgccagcggcaagcucaucaccgaguggugcugccgcuccugcacccugcccccgcugcgguaccgcggggaggacggcugcugguacgggauggagauccggccccucaaggagaaggaggagaaccuggucaacagccuggugacggccggccacgggcagaucgacaacuucucccucggcgugcugggcauggcgcuguuccucgaggagaugcugcgcacccgggucgggaccaagcacgccauccugcucguggccgugagcuucgucacccugaucacgggcaacauguccuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccagcaaggagcugaugaugaccaccaucgggaucguccugcucucccagagcacgauccccgaguccauccuggagcugaccgacgcccucgcgcugggcaugauggugcugaagaucguccggaacauggagaaguaccagcucgccgugaccaucauggccauccugugcgugccgaacgccgucauccugcagaacgccuggaaggugagcugcaccacgcucgcgguggucuccgugagcccccugcugcucaccuccagccagcagaaggccgacuggaucccccuggcccugaccaucaaggggcucaaccccaccgccaucuuccugacgacccugucccgcaccaacaagaagcggagcuggccgcucaacgaggcgaucauggccgugggcauggucuccauccuggccagcucccugcucaagaacgacauccccaugaccggcccccugguggccgggggccugcucacggugugcuacguccugaccgggcgcagcgccgaccuggagcucgagcgggcggccgacgugcgcugggaggagcaggccgagaucagcggcuccagccccauccuguccaucaccaucagcgaggacggguccaugagcaucaagaacgaggaggaggagcagacccugacgauccucauccggaccggccugcuggugaucuccggccucuucccggucagcauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacagccagaucggcgccggcguguacaaggaggggaccuuccacaccauguggcacgucacgcgcggcgcggugcugaugcacaaggggaagcggaucgagcccuccugggccgacgugaagaaggaccucaucagcuacggcgggggcuggaagcuggagggcgaguggaaggagggggaggagguccaggugcuggcccucgagcccggcaagaacccccgcgccgugcagaccaagcccgggcuguucaagaccaacaccggcacgaucggggccgucucccuggacuucagccccggcaccuccggcagccccaucguggacaagaaggggaagguggucggccucuacgggaacggcguggugacccgguccggcaccuacgucagcgcgaucgcccagacggagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcguggucgccgccgagauggaggaggcccuccgcggccugcccauccgguaccagacccccgcgauccgcgccgagcacaccgggcgggagaucguggaccugaugugccacgccaccuucacgaugcgccuccugagccccauccgggugccgaacuacaaccugaucaucauggacgaggcccacuucaccgaccccgccagcaucgcggcccgcggcuacaucuccacccgggucgagaugggcgaggccgccgggaucuucaugaccgccacgccgcccggcagccgcgacccguucccccaguccaacgcgcccaucauggacgaggagcgggagauccccgagcgcagcuggaacuccgggcacgagugggugaccgacuucaagggcaagaccgugugguucgucccgagcaucaaggccgggaacgacaucgccgccugccuccggaagaacggcaagaaggugauccagcugucccgcaagaccuucgacagcgaguacaucaagacgcggaccaacgacugggacuucguggucaccaccgacaucuccgagaugggcgcgaacuucaaggccgagcgcgugaucgacccccggcgcugcaugaagcccgugauccugacggacggggaggagcgggucauccucgccggccccaugccggugacccacagcuccgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccgagcauguucgagcccgagcgggagaaggucgacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgugaagaacaaccagauccuggaggagaacgucgagguggagaucuggacgaaggagggggagcgcaagaagcucaagccgcgguggcuggacgcccgcaucuacuccgacccccuggcccucaaggaguucaaggaguucgcggccggccggaagucccugacccugaaccucaucaccgagaugggccgccugcccaccuucaugacgcagaaggccaagaacgcccuggacaaccucgcggugcugcacaccgccgaggccgggggccgggccuacaaccacgcccuguccgagcuccccgagacccuggagacccugcuccugcugacgcuccuggcgaccgucaccgggggcaucuuccuguuccucaugagcggcaaggggaucggcaagaugacccuggggaugugcugcaucaucaccgccuccauccugcucugguacgcccagauccagccgcacuggaucgccgccagcaucauccuggaguucuuccugaucgugcuccugauccccgagcccgagaagcagcgcacgccccaggacaaccagcugaccuacguggucaucgcgauccucaccgugguggccgccaccauggccaacgagaugggcuuccuggagaagacgaagaaggacuucgggcugggcuccaucaccacccagcagccggagagcaacauccucgacaucgaccugcggcccgccagcgcguggacccuguacgccgucgccacgaccuucaucacccccaugcuccgccacuccaucgagaacagcuccgugaacgugagccugaccgccaucgccaaccaggcgacgguccugaugggccucgggaagggcuggccccuguccaagauggacaucggggugccgcugcucgccaucggcugcuacagccaggugaaccccaucacccugaucgccgcccugcuccugcuggucgcgcacuacgccaucaucgggcccggccuccaggccaaggccacccgggaggcccagaagcgcgcggccgccggcaucaugaagaaccccaccguggacgggaugacggugaucgaccuggacccgauccccuacgaccccaaguucgagaagcagcugggccaggucaugcuccuggugcugugcgugacccagguccucaugaugcggaccaccugggcccugugcgaggcccugacgcucgcgaccgggcccaucuccacccugugggagggcaacccggggcgcuucuggaacaccacgaucgccgugagcauggccaacaucuuccgcggcuccuaccuggccggcgccgggcuccuguucagcaucaugaagaacaccgcgaacacccggcgcggcaccgggaacacgggcgagacccugggcgagaaguggaagaaccggcucaacgcccuggggaaguccgaguuccagaucuacaagaaguccggcauccaggagguggaccgcacccuggccaaggaggggaucaagcggggcgagaccgaccaccacgccgucucccgcgggagcgcgaagcuccggugguucguggagcgcaaccuggugacgcccgagggcaaggucguggaccugggcugcgggcggggcgggugguccuacuacugcggcgggcucaagaacgugaaggaggucaagggccugaccaagggcgggcccggccacgaggagcccaucccgaugagcaccuacggguggaaccuggugcgccuccaguccggcguggacgucuucuucacgccgcccgagaagugcgacacgcugcugugcgacaucggggagagcucccccaacccgaccguggaggccggccggacccuccgcgugcugaaccuggucgagaacuggcucaacaacaacacccaguucugcaucaaggugcugaaccccuacaugcccagcgugaucgagaagauggaggcccugcagcggaaguacggcggggcccugguccgcaacccgcucagccggaacuccacccacgagauguacugggugagcaacgccuccggcaacaucgugagcuccgucaacaugaucagccgcaugcugaucaaccgguucacgaugcgccacaagaaggcgaccuacgagcccgacguggaccugggguccggcacccggaacaucgggaucgagagcgagacccccaaccucgacaucaucggcaagcgcaucgagaagaucaagcaggagcacgagacguccuggcacuacgaccaggaccaccccuacaagaccugggccuaccacggcagcuacgagaccaagcagaccggguccgccagcuccauggugaacggcgucgugcgccugcugacgaagccgugggacgugauccccauggucacccagauggccaugaccgacaccacgcccuucgggcagcagcggguguucaaggagaaggucgacacccgcacccaggagcccaaggagggcaccaagaagcucaugaagaucacggccgaguggcuguggaaggagcugggcaagaagaagaccccgcggaugugcacccgcgaggaguucacccggaaggugcgcagcaacgcggcccucggggccaucuucacggacgagaacaaguggaaguccgcccgggaggccguggaggacagcggcuucugggagcuggucgacaaggagcgcaaccugcaccucgaggggaagugcgagaccugcguguacaacaugaugggcaagcgggagaagaagcugggggaguucggcaaggcgaagggcucccgcgccaucugguacauguggcugggggcccgguuccucgaguucgaggcccugggcuuccugaacgaggaccacugguucagccgcgagaacucccucagcgggguggagggcgaggggcugcacaagcugggcuacauccuccgggacgucagcaagaaggagggcggggcgauguacgccgacgacaccgccggcugggacacccgcaucacgcuggaggaccugaagaacgaggagauggugaccaaccacauggagggggagcacaagaagcucgccgaggccaucuucaagcugaccuaccagaacaaggugguccgggugcagcgccccacgccccggggcacggugauggacaucaucucccgccgggaccagcgcgggagcggccaggucgugaccuacggccugaacaccuucaccaacauggaggcgcagcucauccggcagauggagggggagggcguguucaaguccauccagcagcugacggucaaggaggagaucgccgugaagaacuggcugauccgcguggggcgcgagcggcucagccgcauggccaucuccggcgacgacugcgucgugaagccccuggacgaccgguucgccagcgcccugaccgcgcucaacgacaugggcaaggugcgcaaggacauccagcagugggagccgucccggggguggaacgacuggacccagguccccuucugcagccaccacuuccacgagcugaucaugaaggacggccgcgugcuggugguccccugccggaaccaggacgagcucaucgggcgcgcccggaucucccagggcgccggguggagccugcgcgagaccgccugccugggcaaguccuacgcccagauguggagccucauguacuuccaccggcgcgaccugcggcuggcggccaacgccaucugcuccgccgugcccagccacugggugccgacgucccgcaccaccuggagcauccacgccacccacgaguggaugaccacggaggacaugcucaccgucuggaaccggguguggauccaggagaaccccuggauggaggacaagacccccguggaguccugggaggagauccccuaccugggcaagcgcgaggaccaguggugcgggagccugaucggccucaccagccgggcgacgugggccaagaacauccagaccgccaucaaccagguccgcucccugaucgggaacgaggaguacaccgacuacaugccgagcaugaagcgguuccgccgcgaggaggaggaggccggcgugcugugguga

SEQ ID NO: 9760 - RNA, 9876 nt, Artificial Sequence
  derived and/or modified CDS sequence (opt1) from DENV-2__GQ398265__SS-prME
accgccggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugacguacgggaccugcaccgccaccggcgagcaccggcgcgagaagcggagcgucgcccuggugccccacgugggcauggggcuggagacgcgcaccgagaccuggauguccagcgagggcgccuggaagcacgcccagcggaucgagaccuggauccuccgccaccccggguucacgaucauggcggccauccuggccuacaccaucggcaccaccuacuuccagcggguccugaucuucauccuccugacggccgugacccccuccauggcgaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcguggaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaaggugguccagcccgagaaccucgaguacaccaucgugaucacgccccacuccggcgaggagaacgccguggggaacgacacgggcaagcacgggaaggagaucaaggucaccccgcagagcuccaucaccgaggccgagcugaccggcuacgggaccgugacgauggagugcagcccccgcaccggccuggacuucaacgagauggugcuccugcagauggagaacaaggccuggcugguccaccggcagugguuccucgaccugccccugcccuggcucccgggcgcggacacccagggguccaacuggauccagaaggagacccuggugacguucaagaacccccacgccaagaagcaggacgucguggugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaaggucgugaaggagaucgcggagacccagcacggcaccaucgugauccgcguccaguacgagggggacggcagccccugcaagauccccuucgagaucauggaccuggagaagcggcacgugcugggccgccucaucacggugaacccgaucgucaccgagaaggacucccccgugaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcggggucuucaccuccaucggcaaggcgcugcaccagguguucggggccaucuacggcgccgccuucagcggcguguccuggaccaugaagauccucaucggggucgugaucaccuggaucggcaugaacagccgcuccacgagccuguccgugagccugguccugguggggguggucacccucuaccugggcgugauggugcaggcggacuccgggugcgucgugagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgucacccgccuggagaaccugauguggaagcagaucacccccgagcucaaccacauccugaccgagaacgaggugaagcugacgaucaugaccggggacaucaagggcaucaugcaggccgggaagcggucccuccgcccgcagcccaccgagcugaaguacagcuggaaggcguggggcaaggccaagaugcuguccaccgagcuccacaaccacacguuccugaucgacggccccgagaccgccgagugcccgaacaccaaccgggccuggaacagccuggagguggaggacuacggguucggcgucuucaccacgaacaucuggcucaagcugaaggagcgccaggacguguucugcgacuccaagcugaugagcgccgcgaucaaggacaaccgggccgugcacgccgacaugggguacuggaucgaguccgcccucaacgacaccuggaagaucgagaaggccagcuucaucgaggucaaguccugccacuggcccaagagccacacccugugguccaacggcgugcuggagagcgagaugaucauccccaagaacuucgcgggccccgugucccagcacaacuaccgcccgggguaccacacccagaccgccggccccuggcaccucgggcggcuggagauggacuucgacuucugcgagggcacgaccgucguggugaccgaggacugcgggaaccgcggccccagccugcggaccacgaccgccagcggcaagcucaucaccgaguggugcugccgcuccugcacccugcccccgcugcgguaccgcggggaggacggcugcugguacgggauggagauccggccccucaaggagaaggaggagaaccuggucaacagccuggugacggccggccacgggcagaucgacaacuucucccucggcgugcugggcauggcgcuguuccucgaggagaugcugcgcacccgggucgggaccaagcacgccauccugcucguggccgugagcuucgucacccugaucacgggcaacauguccuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccagcaaggagcugaugaugaccaccaucgggaucguccugcucucccagagcacgauccccgaguccauccuggagcugaccgacgcccucgcgcugggcaugauggugcugaagaucguccggaacauggagaaguaccagcucgccgugaccaucauggccauccugugcgugccgaacgccgucauccugcagaacgccuggaaggugagcugcaccacgcucgcgguggucuccgugagcccccugcugcucaccuccagccagcagaaggccgacuggaucccccuggcccugaccaucaaggggcucaaccccaccgccaucuuccugacgacccugucccgcaccaacaagaagcggagcuggccgcucaacgaggcgaucauggccgugggcauggucuccauccuggccagcucccugcucaagaacgacauccccaugaccggcccccugguggccgggggccugcucacggugugcuacguccugaccgggcgcagcgccgaccuggagcucgagcgggcggccgacgugcgcugggaggagcaggccgagaucagcggcuccagccccauccuguccaucaccaucagcgaggacggguccaugagcaucaagaacgaggaggaggagcagacccugacgauccucauccggaccggccugcuggugaucuccggccucuucccggucagcauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacagccagaucggcgccggcguguacaaggaggggaccuuccacaccauguggcacgucacgcgcggcgcggugcugaugcacaaggggaagcggaucgagcccuccugggccgacgugaagaaggaccucaucagcuacggcgggggcuggaagcuggagggcgaguggaaggagggggaggagguccaggugcuggcccucgagcccggcaagaacccccgcgccgugcagaccaagcccgggcuguucaagaccaacaccggcacgaucggggccgucucccuggacuucagccccggcaccuccggcagccccaucguggacaagaaggggaagguggucggccucuacgggaacggcguggugacccgguccggcaccuacgucagcgcgaucgcccagacggagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacccugauccuggccccgacgcgcguggucgccgccgagauggaggaggcccuccgcggccugcccauccgguaccagacccccgcgauccgcgccgagcacaccgggcgggagaucguggaccugaugugccacgccaccuucacgaugcgccuccugagccccauccgggugccgaacuacaaccugaucaucauggacgaggcccacuucaccgaccccgccagcaucgcggcccgcggcuacaucuccacccgggucgagaugggcgaggccgccgggaucuucaugaccgccacgccgcccggcagccgcgacccguucccccaguccaacgcgcccaucauggacgaggagcgggagauccccgagcgcagcuggaacuccgggcacgagugggugaccgacuucaagggcaagaccgugugguucgucccgagcaucaaggccgggaacgacaucgccgccugccuccggaagaacggcaagaaggugauccagcugucccgcaagaccuucgacagcgaguacaucaagacgcggaccaacgacugggacuucguggucaccaccgacaucuccgagaugggcgcgaacuucaaggccgagcgcgugaucgacccccggcgcugcaugaagcccgugauccugacggacggggaggagcgggucauccucgccggccccaugccggugacccacagcuccgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccgagcauguucgagcccgagcgggagaaggucgacgccaucgacggcgaguaccgccugcgcggggaggcccgcaagaccuucguggaccugaugcggcgcggcgaccuccccgucuggcuggccuaccggguggcggccgaggggaucaacuacgccgaccgccgguggugcuucgacggcgugaagaacaaccagauccuggaggagaacgucgagguggagaucuggacgaaggagggggagcgcaagaagcucaagccgcgguggcuggacgcccgcaucuacuccgacccccuggcccucaaggaguucaaggaguucgcggccggccggaagucccugacccugaaccucaucaccgagaugggccgccugcccaccuucaugacgcagaaggccaagaacgcccuggacaaccucgcggugcugcacaccgccgaggccgggggccgggccuacaaccacgcccuguccgagcuccccgagacccuggagacccugcuccugcugacgcuccuggcgaccgucaccgggggcaucuuccuguuccucaugagcggcaaggggaucggcaagaugacccuggggaugugcugcaucaucaccgccuccauccugcucugguacgcccagauccagccgcacuggaucgccgccagcaucauccuggaguucuuccugaucgugcuccugauccccgagcccgagaagcagcgcacgccccaggacaaccagcugaccuacguggucaucgcgauccucaccgugguggccgccaccauggccaacgagaugggcuuccuggagaagacgaagaaggacuucgggcugggcuccaucaccacccagcagccggagagcaacauccucgacaucgaccugcggcccgccagcgcguggacccuguacgccgucgccacgaccuucaucacccccaugcuccgccacuccaucgagaacagcuccgugaacgugagccugaccgccaucgccaaccaggcgacgguccugaugggccucgggaagggcuggccccuguccaagauggacaucggggugccgcugcucgccaucggcugcuacagccaggugaaccccaucacccugaccgccgcccugcuccugcuggucgcgcacuacgccaucaucgggcccggccuccaggccaaggccacccgggaggcccagaagcgcgcggccgccggcaucaugaagaaccccacgguggacgggaugaccgugaucgaccuggacccgauccccuacgaccccaaguucgagaagcagcugggccaggucaugcuccuggugcugugcgugacccagguccucaugaugcggaccacgugggcccugugcgaggcccugacccucgcgaccgggcccaucuccacccugugggagggcaacccggggcgcuucuggaacacgaccaucgccgugagcauggccaacaucuuccgcggcuccuaccuggccggcgccgggcuccuguucagcaucaugaagaacaccgcgaacacccggcgcggcacggggaacaccggcgagacccugggcgagaaguggaagaaccggcucaacgcccuggggaaguccgaguuccagaucuacaagaaguccggcauccaggagguggaccgcacccuggccaaggaggggaucaagcggggcgagacggaccaccacgccgucucccgcgggagcgcgaagcuccggugguucguggagcgcaaccuggugacccccgagggcaaggucguggaccugggcugcgggcggggcgggugguccuacuacugcggcgggcucaagaacgugaaggaggucaagggccugaccaagggcgggcccggccacgaggagcccaucccgaugagcaccuacggguggaaccuggugcgccuccaguccggcguggacgucuucuucacgccgcccgagaagugcgacacccugcugugcgacaucggggagagcucccccaacccgaccguggaggccggccggacccuccgcgugcugaaccuggucgagaacuggcucaacaacaacacccaguucugcaucaaggugcugaaccccuacaugcccagcgugaucgagaagauggaggcccugcagcggaaguacggcggggcccugguccgcaacccgcucagccggaacuccacgcacgagauguacugggugagcaacgccuccggcaacaucgugagcuccgucaacaugaucagccgcaugcugaucaaccgguucaccaugcgccacaagaaggcgaccuacgagcccgacguggaccugggguccggcacccggaacaucgggaucgagagcgagacgcccaaccucgacaucaucggcaagcgcaucgagaagaucaagcaggagcacgagaccuccuggcacuacgaccaggaccaccccuacaagaccugggccuaccacggcagcuacgagaccaagcagacgggguccgccagcuccauggugaacggcgucgugcgccugcugaccaagccgugggacgugauccccauggucacccagauggccaugaccgacacgacccccuucgggcagcagcggguguucaaggagaaggucgacacccgcacccaggagcccaaggagggcacgaagaagcucaugaagaucaccgccgaguggcuguggaaggagcugggcaagaagaagaccccgcggaugugcacccgcgaggaguucacgcggaaggugcgcagcaacgcggcccucggggccaucuucaccgacgagaacaaguggaaguccgcccgggaggccguggaggacagcggcuucugggagcuggucgacaaggagcgcaaccugcaccucgaggggaagugcgagaccugcguguacaacaugaugggcaagcgggagaagaagcugggggaguucggcaaggcgaagggcucccgcgccaucugguacauguggcugggggcccgguuccucgaguucgaggcccugggcuuccugaacgaggaccacugguucagccgcgagaacucccucagcgggguggagggcgaggggcugcacaagcugggcuacauccuccgggacgucagcaagaaggagggcggggcgauguacgccgacgacaccgccggcugggacacgcgcaucacccuggaggaccugaagaacgaggagauggugaccaaccacauggagggggagcacaagaagcucgccgaggccaucuucaagcugaccuaccagaacaaggugguccgggugcagcgccccacgccccggggcaccgugauggacaucaucucccgccgggaccagcgcgggagcggccaggucgugaccuacggccugaacaccuucacgaacauggaggcgcagcucauccggcagauggagggggagggcguguucaaguccauccagcagcugaccgucaaggaggagaucgccgugaagaacuggcugauccgcguggggcgcgagcggcucagccgcauggccaucuccggcgacgacugcgucgugaagccccuggacgaccgguucgccagcgcccugaccgcgcucaacgacaugggcaaggugcgcaaggacauccagcagugggagccgucccggggguggaacgacuggacccagguccccuucugcagccaccacuuccacgagcugaucaugaaggacggccgcgugcuggugguccccugccggaaccaggacgagcucaucgggcgcgcccggaucucccagggcgccggguggagccugcgcgagacggccugccugggcaaguccuacgcccagauguggagccucauguacuuccaccggcgcgaccugcggcuggcggccaacgccaucugcuccgccgugcccagccacugggugccgaccucccgcaccaccuggagcauccacgccacccacgaguggaugacgaccgaggacaugcucaccgucuggaaccggguguggauccaggagaaccccuggauggaggacaagacccccguggaguccugggaggagauccccuaccugggcaagcgcgaggaccaguggugcgggagccugaucggccucacgagccgggcgaccugggccaagaacauccagaccgccaucaaccagguccgcucccugaucgggaacgaggaguacaccgacuacaugccgagcaugaagcgguuccgccgcgaggaggaggaggccggcgugcugugguga

SEQ ID NO: 9761 - RNA, 9876 nt, Artificial Sequence
  derived and/or modified CDS sequence (opt1) from DENV-2__KX702403__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagacguggauccugcgccacccgggcuucaccaucauggccgcgauccuggccuacaccaucgggaccacgcacuuccagcgggcccucauccugauccugcucaccgccguggcgcccagcaugaccaugcgcugcaucggcaucuccaaccgggacuucgucgagggcgugagcgggggcuccuggguggacaucguccuggagcacgggagcugcgugaccacgauggccaagaacaagcccacccuggacuucgagcucaucaagaccgaggccaagcagcccgccacccugcgcaaguacugcaucgaggccaagcugacgaacaccaccaccgagucccggugcccgacgcagggcgagcccagccucaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagaucgugcagcccgagaaccuggaguacaccaucgugaucacgccccacagcggggaggagcacgccgucggcaacgacaccgggaagcacggcaaggagaucaagaucaccccgcaguccagcaccaccgaggccgagcucacgggguacggcaccgugaccauggagugcagcccccggaccggccuggacuucaacgagauggugcugcuccagauggaggacaaggccuggcugguccaccggcagugguuccuggaccucccccugcccuggcugccgggggccgacacgcagggcagcaacuggauccagaaggagacccucgugaccuucaagaacccccacgcgaagaagcaggacguggucgugcuggggucccaggagggcgccaugcacaccgcccugacgggggccaccgagauccagaugagcagcggcaaccuccuguucaccggccaccugaagugccgccuccggauggacaagcugcagcugaaggggauguccuacagcaugugcaccggcaaguucaagaucgucaaggagaucgccgagacgcagcacgggaccaucgugauccgcgugcaguacgagggcgacggcucccccugcaagauccccuucgagaucaccgaccucgagaagcggcacguccuggggcgccugaucaccgugaacccgaucgugacggagaaggacagccccgucaacaucgaggcggagccgcccuucggcgacuccuacaucaucguggggguggagccgggccagcucaagcugaacugguucaagaaggggagcuccaucggccagauguucgagaccaccaugcgcggcgccaagcggauggccauccugggggacaccgccugggacuucggcagccucgggggcgucuucacguccaucgggaaggcccugcaccagguguucggcgcgaucuacggcgccgccuucagcgggguguccuggaccaugaagauccugaucggcgucaucaucaccuggaucgggaugaacagccgcuccaccagccuguccgugagccucgugcuggucggcguggugacgcuguaccucggggccaugguccaggcggacuccggcugcaucgugagcuggaagaacaaggagcugaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccucgagaaccugauguggaagcagaucacccccgagcugaaccacauccucuccgagaacgaggugaagcugaccaucaugaccggcgacaucaaggggaucaugcaggccggcaagcggagccugcgcccgcagcccacggagcucaaguacuccuggaagaccuggggcaaggcgaagaugcugagcaccgagucccacaaccagaccuuccugaucgacgggcccgagacggccgagugcccgaacaccaaccgggccuggaacagccucgagguggaggacuacggcuucggggucuucaccaccaacaucuggcugaagcugcgcgagaagcaggacguguucugcgacuccaagcucaugagcgccgccaucaaggacaaccgggcggugcacgccgacaugggcuacuggaucgaguccgcccugaacgacaccuggaagauggagaaggccagcuucaucgaggucaaguccugccacuggcccaagagccacacgcugugguccaacggcgugcucgagagcgagaugaucauccccaagaacuucgccgggcccgugucccagcacaacuaccgcccgggcuaccacacccagaccgcggggcccuggcaccugggcaagcuggagauggacuucgacuucugcgaggggaccacggucguggugaccgaggacugcgagaagcggggccccagccuccgcaccaccacggccagcggcaagcugaucaccgaguggugcugccgguccugcacccugcccccgcuccgcuaccgcggggaggacggcugcugguacgggauggagauccgcccccugaaggagaaggaggagaaccuggucaacagccucgugaccgccggccacgggcagaucgacaacuucucccugggcgugcugggcauggcccucuuccuggaggagaugcugcggacgcgcgucgggaccaagcacgcgauccuccugguggcccugagcuucgugacccucaucaccggcaacauguccuuccgggaccuggggcgcgucauggugauggugggcgccacgaugaccgacgacaucgggaugggcgucaccuaccuggcccuccuggccgcguucaaggugcgccccaccuucgccgccggccugcuccugcggaagcugacgagcaaggagcucaugauggccaccaucgggaucgcccugcugucccagagcacccuccccgagaccauccuggagcugacggacgcgcucgcccugggcaugauggcccugaagaucgugcgcaacauggagaaguaccagcucgccgucaccaucauggccaucuccugcgugccgaacgcggugauccugcagaacgccuggaaggucagcugcaccauccuggccgccguguccgugagcccccuccugcugaccuccagccagcagaaggcggacuggaucccccucgcccugacgaucaaggggcugaaccccaccgccaucuuccucaccacccugucccggacgagcaagaagcgcuccuggccgcugaacgaggccaucauggccgucggcauggugagcauccucgcguccagccugcugaagaacgacauccccaugaccggcccccucgucgccgggggccugcugaccgugugcuacgugcucaccgggcggagcgccgaccuggagcuggagcgcgccgccgacgucaagugggaggaccaggcggagaucuccggcagcucccccauccucagcaucacgaucuccgaggacgggagcauguccaucaagaacgaggaggaggagcagacccugaccauccugauccggaccggccuccuggugaucagcggcguguucccggucuccauccccaucaccgccgccgccugguaccugugggaggugaagaagcagcgcgccggggugcucugggacguccccagcccgccgcccgugggcaaggcggagcuggaggacggggccuaccggaucaagcagcgcggcauccugggguacucccagaucggcgccggcguguacaaggaggggacguuccacaccauguggcacgucacccggggcgccgugcucaugcaccgcgggaagcggaucgagcccagcugggccgacgugaagaaggaccugaucuccuacggcgggggcuggaagcuggagggcgaguggaaggagggggaggagguccaggugcucgcgcuggagcccggcaagaacccccgcgccgugcagaccaagcccgggaucuucaagacgaacaccggcaccaucggggccgucagccuggacuucucccccggcaccagcggcucccccaucguggaccggaaggggaagguggucggccucuacgggaacggcguggugacgcgcagcggcgccuacgucuccgcgaucgcccagaccgagaaguccaucgaggacaaccccgagaucgaggacgacaucuuccggaagaagcgccugaccaucauggaccugcaccccggggccggcaagaccaagcgguaccugcccgccaucgugcgcgaggccaucaagcgggggcuccgcacgcugauccuggcgccgacccgcguggucgccgccgagauggaggaggcccuccggggccugcccauccgcuaccagacccccgccauccgggcggagcacaccgggcgcgagaucguggaccugaugugccacgccacguucaccaugcggcuccugagccccgugcgcgucccgaacuacaaccugaucaucauggacgaggcccacuucaccgaccccgccuccaucgccgcgcggggcuacaucagcacccgcguggagaugggcgaggccgccgggaucuucaugacggccacgccgcccggcucccgggacccguucccccagagcaacgcgcccaucauggacgaggagcgcgagauccccgagcgguccuggaacagcgggcacgagugggugaccgacuucaagggcaagaccgucugguucgugccguccaucaaggccgggaacgacaucgccgccugccuccgcaagaacggcaagaaggugauccagcugagccggaagacguucgacuccgaguacgucaagacccgcgccaacgacugggacuucguggugaccaccgacaucagcgagaugggcgcgaacuucaaggccgagcgggucaucgacccccgccggugcaugaagcccgugauccugacggacggggaggagcgcgugauccucgccggccccaugccggucacccacuccagcgccgcccagcggcgcgggcgcaucggccggaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucguggaccugaugcgccggggcgaccuccccgucuggcuggccuacaagguggcggccgaggggaucaacuacgccgaccgcaaguggugcuucgacggcaucaagaacaaccagauccuggaggagaacguggaggucgagaucuggacgaaggagggggagcggaagaagcucaagccgcgcuggcuggacgcccggaucuacagcgacccccuggcgcucaaggaguucaaggaguucgccgccggccgcaagucccugacccugaaccucaucaccgagaugggccggcugcccaccuucaugacgcagaaggcccgcaacgcccuggacaaccucgcggugcugcacaccgccgaggucgggggcaaggccuacacccacgcccugagcgagcuccccgagacccuggagacgcugcuccugcugacccuccuggccgcggucaccgggggcaucuuccuguuccucauguccggcaaggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcggacgccccaggacaaccagcugaccuacgucgugaucgcgauccucaccguggucgccgccaccauggccaacgagaugggcuuccuggagaagacgaagaaggaccugggguucggcagcaucaccacccaggagagcgaguccaacauccucgacaucgaccugcgcccggccagcgcguggacccuguacgccguggccacgaccuucgugacccccaugcuccggcacuccaucgagaacagcuccgucaacgugagccugaccgccaucgcgaaccaggccacggugcugaugggccucgggaagggcuggccccuguccaagauggacaucggggucccccugcucgccaucggcugcuacagccaggugaacccgaucacccugaccgccgcccugcuccugcugguggcgcacuacgccaucaucgggcccggccuccaggccaaggccacccgcgaggcccagaagcgggcggccgccggcaucaugaagaaccccacggucgacgggaucaccgugaucgaccuggagcccaucccgcacgaccccaaguucgagaagcagcugggccaggugaugcuccugauccugugcgucacccaggugcucaugaugcgcaccacgugggcccugugcgaggcccugacccucgcgaccgggcccaucuccacccugugggagggcaaccccgggcgguucuggaacacgaccaucgccgugagcauggccaacaucuuccgcggcuccuaccuggccggcgcggggcuccuguucagcaucaugaagaacaccaccaacacgcgccggggcaccgggaacgucggcgagacccugggcgagaaguggaagucccgccucaacgcccugggcaagagcgaguuccagaucuacaagaaguccggcauccaggagguggaccggacccuggccaaggaggggaucaagcgcggcgagacggaccaccacgccgugagccggggguccgccaagcuccgcugguucgucgagcggaacauggugaccccggagggcaagguggucgaccugggcugcgggcgcggcggguggagcuacuacugcggcgggcugaagaacgugcgggaggugaagggccucaccaagggcgggcccggccacgaggagcccauccccauguccaccuacggguggaaccugguccgccugcagagcggcguggacguguucuucacgccgcccgagaagugcgacacccuccugugcgacaucggggagagcucccccaaccccaccaucgaggcgggccggacccugcgcguccucaaccugguggagaacuggcugaacaacaacacccaguucugcaucaaggugcucaacccguacaugcccagcgucaucgagaagauggagacgcugcagcggaaguacggcggggcccuggugcgcaacccccugucccggaacagcacccacgagauguacuggguguccaacgccaccggcaacaucgucagcuccgugaacaugaucagccgcaugcucaucaaccgguucaccaugaagcacaagaaggccacguacgagccggacguggaccugggguccggcacccgcaacaucgggaucgagagcgagacccccaaccuggacaucaucggcaagcggaucgagaagaucaagcaggagcacgagaccuccuggcacuacgaccaggaccaccccuacaagacgugggccuaccacggcagcuacgagaccaagcagaccggguccgcgagcuccauggucaacggcguggugcgccuccugaccaagcccugggacgucgugccgauggugacgcagauggccaugaccgacaccacccccuucgggcagcagcgcgucuucaaggagaagguggacacgcggacccaggagcccaaggagggcaccaagaagcugaugaagaucaccgccgaguggcucuggaaggagcugggcaaggagaagacgccccgcaugugcacccgggaggaguucacccgcaaggugcggagcaacgccgcccugggggcggucuucaccgacgagaacaaguggaaguccgcccgcgaggccguggaggacggccgguucugggagcucguggaccgcgagcggaaccugcaccuggaggggaagugcgagacgugcgucuacaacaugaugggcaagcgcgagaagaagcucggggaguucggcaaggccaagggcagccgggcgaucugguacauguggcugggggcccgcuuccuggaguucgaggcccucggcuuccugaacgaggaccacugguucucccgggggaacagccugagcggcguggagggggagggccuccaccgccugggcuacauccugcgggaggucgggaagaaggagggcggggccauguacgccgacgacaccgcgggcugggacacccgcaucacccucgaggaccugaagaacgaggagauggugacgaaccacaugaagggggagcacaagaagcuggccgaggccaucuucaagcucaccuaccagaacaaggugguccgggugcagcgcccgacgccccggggcaccgugauggacaucaucucccgcaaggaccagcggggcagcgggcaggucggcacguacgggcugaacaccuucaccaacauggaggcccagcugauccgccagauggagggcgagggcaucuucaaguccauccagcaccucaccgccacggaggagaccgcggugcagaacuggcuggcccgcguggggcgggagcgccugagccggauggccaucuccggcgacgacugcgucgugaagcccaucgacgaccgcuucgccagcgcccucaccgcgcugaacgacauggggaaggugcggaaggacauccagcagugggagcccucccgcggcuggaacgacuggacccaggucccguucugcagccaccacuuccacgagcuggugaugaaggacgggcgggugcucgucgugcccugccgcaaccaggacgagcugaucggccgggcccgcaucucccagggcgccggguggagccugaaggagaccgccugccucggcaaguccuacgcccagauguggacgcugauguacuuccaccggcgcgaccugcggcucgcggccaacgccaucugcagcgccgugcccucccacuggguccccaccagccgcaccaccugguccauccacgcgaagcacgaguggaugacgaccgaggacaugcuggccguguggaaccggguguggauccaggagaacccguggauggaggacaagacccccgucgagagcugggaggaggugcccuaccuggggaagcgcgaggaccaguggugcggcucccucaucgggcugaccagccgggccacgugggccaagaacauccagaccgccaucaaccaggugcgcagccugaucggcaacgagggcuacaccgacuacaugcccuccaugaagcgguuccgccgcgaggaggaggaggcggggguccucugguga

SEQ ID NO: 9762 - RNA, 9876 nt, Artificial Sequence
  derived and/or modified CDS sequence (opt1) from DENV-2__KX702404__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaccaccgaggccgagcugacgggguacggcaccgugaccauggagugcagcccccgcaccggccucgacuucaacgagaugguccugcugcagauggaggacaaggccuggcucgugcaccggcagugguuccuggaccugccccuccccuggcugccgggggccgacacgcagggcagcaacuggauccagaaggagacccuggugaccuucaagaacccccacgcgaagaagcaggacgucgugguccucgggucccaggagggcgccaugcacaccgcccugacgggggccaccgagauccagaugagcagcggcaaccuccuguucaccggccaccugaagugccgccugcggauggacaagcuccagcugaaggggauguccuacagcaugugcaccggcaaguucaagguggugaaggagaucgccgagacgcagcacgggaccaucgucauccgcgugcaguacgagggcgacggcucccccugcaagauccccuucgagaucaccgaccuggagaagcggcacgugcucgggcgccugaucaccgucaacccgaucgugacggagaaggacagccccgugaacaucgaggcggagccgcccuucggcgacuccuacaucaucgucgggguggagccgggccagcugaagcucaacugguucaagaaggggagcuccaucggccagauguucgagaccaccaugcgcggcgccaagcggauggccauccugggggacaccgccugggacuucggcagccucgggggcguguucacguccaucgggaaggcccuccaccaggucuucggcgcgaucuacggcgccgccuucagcgggguguccuggaccaugaagauccugaucggcgugaucaucaccuggaucgggaugaacagccgcuccaccagccuguccgucagccuggugcucgugggcgucgugacgcuguaccugggggccauggugcaggcggacuccggcugcgucgugagcuggaagaacaaggagcucaagugcggcuccgggaucuucaucaccgacaacgugcacaccuggaccgagcaguacaaguuccagcccgagagccccagcaagcuggccuccgccauccagaaggcccacgaggagggcaucugcgggauccggagcgucacgcgccuggagaaccucauguggaagcagaucacccccgagcugaaccacauccuguccgagaacgagaucaagcucaccaucaugaccggcgacaucaaggggaucaugcaggccggcaagcggagccugcgcccgcagcccacggagcugaaguacuccuggaagaccuggggcaaggcgaagaugcucagcaccgagucccacaaccagaccuuccugaucgacgggcccgagacggccgagugcccgaacaccaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacacgcugugguccaacggcguccuggagagcgagaugaucauccccaagaacuucgccgggcccgugucccagcacaacuaccgcccgggcuaccacacccagaccgcggggcccuggcaccucggcaagcuggagauggacuucgacuucugcgaggggaccacgguggucgugaccgaggacugcggcaaccggggccccagccugcgcaccaccacggccagcgggaagcucaucaccgaguggugcugccgguccugcacccugcccccgcugcgcuaccggggcgaggacgggugcugguacggcauggagauccgcccccucaaggagaaggaggagaaccuggugaacagccuggucaccgccgggcacggccagaucgacaacuucucccucggcgugcuggggauggcccuguuccucgaggagaugcugcggacgcgcgugggcaccaagcacgcgauccugcucgucgcccugagcuucgugacccugaucaccgggaacauguccuuccgggaccucggccgcgugauggucauggugggggccacgaugaccgacgacaucggcaugggcgugaccuaccuggcccugcucgccgcguucaagguccgccccaccuucgccgccgggcugcugcuccggaagcugacgagcaaggagcugaugauggccaccaucggcaucgcccuccugucccagagcacccugcccgagaccauccucgagcugacggacgcgcuggcccucgggaugauggcccugaagaucgugcgcaacauggagaaguaccagcuggccgugaccaucauggccaucuccugcgucccgaacgcggugauccuccagaacgccuggaaggugagcugcaccauccuggccgccgucuccgugagcccccugcuccugaccuccagccagcagaaggcggacuggaucccccuggcccucacgaucaagggccugaaccccaccgccaucuuccugaccacccucucccggacgagcaagaagcgcuccuggccgcugaacgaggccaucauggccgucggcauggugagcauccuggcguccagccuccugaagaacgacauccccaugaccgggccccugguggccggcgggcuccugaccgucugcuacgugcugaccggccggagcgccgaccucgagcuggagcgcgccgccgacgugaagugggaggaccaggcggagaucuccgggagcucccccauccugagcaucacgaucuccgaggacggcagcauguccaucaagaacgaggaggaggagcagacccucaccauccugauccggaccggccugcucgucaucagcgggguguucccgguguccauccccaucaccgccgccgccugguaccugugggaggucaagaagcagcgcgccggcgugcugugggacgugcccagcccgccgcccgucgagaaggcggagcucgaggacggggccuaccggaucaagcagcgcggcauccugggguacucccagaucggcgccggcguguacaaggaggggacguuccacaccauguggcacgugacccggggcgccguccugaugcaccgcgggaagcggaucgagcccagcugggccgacgugaagaaggaccucaucuccuacggcgggggcuggaagcuggagggcgaguggaaggagggggaggaggugcagguccuggcgcucgagcccggcaagaacccccgcgccgugcagaccaagcccgggaucuucaagacgaacaccggcaccaucggggccgugagccuggacuucucccccggcaccagcggcucccccaucgucgaccggaaggggaagguggugggccuguacgggaacggcgucgugacgcgcagcggcgccuacguguccgcgaucgcccagaccgagaaguccaucgaggacaaccccgagaucgaggacgacaucuuccggaagaagcgccucaccaucauggaccugcaccccggggccggcaagaccaagcgguaccugcccgccaucguccgcgaggccaucaagcgggggcugcgcacgcucauccuggcgccgacccgcgugguggccgccgagauggaggaggcccugcggggccuccccauccgcuaccagacccccgccauccgggcggagcacaccgggcgcgagaucgucgaccugaugugccacgccacguucaccaugcggcugcucagccccgugcgcgugccgaacuacaaccugaucaucauggacgaggcccacuucaccgaccccgccuccaucgccgcgcggggcuacaucagcacccgcgucgagaugggcgaggccgccgggaucuucaugacggccacgccgcccggcucccgggacccguucccccagagcaacgcgcccaucauggacgaggagcgcgagauccccgagcgguccuggaacagcgggcacgagugggugaccgacuucaagggcaagaccgugugguucgucccguccaucaaggccgggaacgacaucgccgccugccugcgcaagaacggcaagaaggugauccagcucagccggaagacguucgacuccgaguacgugaagacccgcgccaacgacugggacuucgucgugaccaccgacaucagcgagaugggcgcgaacuucaaggccgagcgggugaucgacccccgccggugcaugaagcccgucauccugacggacggggaggagcgcgugauccuggccggccccaugccggugacccacuccagcgccgcccagcggcgcgggcgcaucggccggaaccccaagaacgagaacgaccaguacaucuacaugggggagccccucgagaacgacgaggacugcgcgcacuggaaggaggccaagaugcugcuggacaacaucaacacccccgagggcaucaucccguccauguucgagcccgagcgcgagaaggucgacgccaucgacggcgaguaccggcuccgcggggaggcccggaagaccuucguggaccugaugcgccggggcgaccugcccguguggcucgccuacaaggucgcggccgaggggaucaacuacgccgaccgcaaguggugcuucgacggcaucaagaacaaccagauccuggaggagaacguggagguggagaucuggacgaaggagggggagcggaagaagcugaagccgcgcuggcucgacgcccggaucuacagcgacccccuggcgcugaaggaguucaaggaguucgccgccggccgcaagucccucacccugaaccugaucaccgagaugggccggcuccccaccuucaugacgcagaaggcccgcaacgcccuggacaaccuggcgguccuccacaccgccgaggucgggggcaaggccuacacccacgcccugagcgagcugcccgagacccucgagacgcugcugcuccugacccugcucgccgcggucaccgggggcaucuuccuguuccugauguccggcaaggggaucggcaagaugacccucgggaugugcugcaucaucaccgccagcauccugcugugguacgcccagauccagccgcacuggaucgccgccuccaucauccucgaguucuuccugaucgugcugcucauccccgagcccgagaagcagcggacgccccaggacaaccagcugaccuacguggucaucgcgauccugaccgugguggccgccaccauggccaacgagaugggcuuccucgagaagacgaagaaggaccugggguucggcagcaucaccacccaggagagcgaguccaacauccuggacaucgaccuccgcccggccagcgcguggacccuguacgccgucgccacgaccuucgugacccccaugcugcggcacuccaucgagaacagcuccgugaacgucagccucaccgccaucgcgaaccaggccacggugcugaugggccuggggaagggcuggccccucuccaagauggacaucggggugccccugcuggccaucggcugcuacagccaggucaacccgaucacccucaccgccgcccugcugcuccugguggcgcacuacgccaucaucgggcccggccugcaggccaaggccacccgcgaggcccagaagcgggcggccgccggcaucaugaagaaccccacgguggacgggaucaccgucaucgaccucgagcccaucccguacgaccccaaguucgagaagcagcugggccaggugaugcugcucauccugugcgugacccagguccugaugaugcgcaccacgugggcccucugcgaggcccugacccuggcgaccgggcccaucuccacccucugggagggcaaccccgggcgguucuggaacacgaccaucgccgugagcauggccaacaucuuccgcggcuccuaccuggccggcgcggggcuccuguucagcaucaugaagaacaccaccaacacgcgccggggcaccgggaacgugggcgagacccugggcgagaaguggaagucccgccugaacgcccucggcaagagcgaguuccagaucuacaagaaguccggcauccaggaggucgaccggacccuggccaaggaggggaucaagcgcggcgagacggaccaccacgccgugagccggggguccgccaagcugcgcugguucguggagcggaacauggucaccccggagggcaaggugguggaccucggcugcgggcgcggcggguggagcuacuacugcggcgggcugaagaacguccgggaggugaagggccugaccaagggcgggcccggccacgaggagcccauccccauguccaccuacggguggaaccucgugcgccugcagagcggcgucgacguguucuucacgccgcccgagaagugcgacacccugcucugcgacaucggggagagcucccccaaccccaccaucgaggcgggccggacccugcgcgugcugaaccucgucgagaacuggcugaacaacaacacccaguucugcaucaaggugcugaacccguacaugcccagcgugaucgagaagauggagacgcuccagcggaaguacggcggggcccugguccgcaacccccugucccggaacagcacccacgagauguacuggguguccaacgccaccggcaacaucgugagcuccgucaacaugaucagccgcaugcugaucaaccgguucaccaugaagcacaagaaggccacguacgagccggacguggaccucggguccggcacccgcaacaucgggaucgagagcgagauccccaaccuggacaucgugggcaagcggaucgagaagaucaagcaggagcacgagaccuccuggcacuacgaccaggaccaccccuacaagaccugggccuaccacggcagcuacgagacgaagcagaccggguccgcgagcuccauggucaacggcguggugcgccugcucaccaagcccugggacgucgugccgauggugacccagauggccaugacggacaccacccccuucgggcagcagcgcgucuucaaggagaagguggacacccggacgcaggagcccaaggagggcaccaagaagcugaugaagaucaccgccgaguggcuguggaaggagcucggcaaggagaagacgccccgcaugugcacgcgggaggaguucacccgcaaggugcggagcaacgccgcccugggggcggucuucaccaacgagaacaaguggaaguccgcccgcgaggccguggaggacggccgguucugggagcuggucgaccgcgagcggaaccuccaccuggaggggaagugcgagaccugcguguacaacaugaugggcaagcgcgagaagaagcugggggaguucggcaaggccaagggcagccgggcgaucugguacauguggcucggggcccgcuuccuggaguucgaggcccugggcuuccucaacgaggaccacugguucucccgggggaacagccugagcggcguggagggggagggccugcaccgccucggcuacauccugcgggaggucgggaagaaggagggcggggccauguacgccgacgacacggcgggcugggacacccgcaucacccuggaggaccucaagaacgaggagauggugaccaaccacaugaagggggagcacaagaagcuggccgaggccaucuucaagcugacguaccagaacaaggugguccgggugcagcgcccgacgccccggggcaccgugauggacaucaucucccgcaaggaccagcggggcagcgggcaggucggcaccuacgggcucaacacguucaccaacauggaggcccagcugauccgccagauggagggcgagggcaucuucaaguccauccagcaccugaccgccaccgaggagaucgcggugcagaacuggcucgcccgcguggggcgggagcgccugagccggauggccaucuccggcgacgacugcgucgugaagcccaucgacgaccgcuucgccagcgcccugacggcgcucaacgacauggggaaggugcggaaggacauccagcagugggagcccucccgcggcuggaacgacuggacccaggucccguucugcagccaccacuuccacgagcuggugaugaaggacgggcgggugcuggucgugcccugccgcaaccaggacgagcucaucggccgggcccgcaucucccagggcgccggguggagccugaaggagaccgccugccugggcaaguccuacgcccagauguggacccucauguacuuccaccggcgcgaccugcggcuggcggccaacgccaucugcagcgccgugcccucccacuggguccccaccagccgcacgaccugguccauccacgcgaagcacgaguggaugaccaccgaggacaugcucgccguguggaaccggguguggauccaggagaacccguggauggaggacaagacgcccgucgagagcugggaggaggugcccuaccuggggaagcgcgaggaccaguggugcggcucccugaucgggcucaccagccgggccaccugggccaagaacauccagaccgccaucaaccaggugcgcagccugaucggcaacgagggcuacacggacuacaugcccuccaugaagcgguuccgccgcgaggaggaggaggcggggguccugugguga

SEQ ID NO: 9763 - RNA, 9873 nt, Artificial Sequence
  derived and/or modified CDS sequence (opt1) from DENV-2__JQ686088__SS-prME
accaccggcaugaucaucaugcugauccccaccgugauggcguuccaccucaccacccggaacggggagccccacaugaucgugucccggcaggacaagggcaagucccugcuguucaagaccaaggacgggaccaacaugugcacccucauggcgauggaccugggcgagcugugcgaggacaccaucaccuacaagugccccuuccucaagcagaacgagcccgaggacaucgacugcuggugcaacagcacguccaccugggugaccuacgggaccugcacgaccaccggcgagcaccgccgggagaagcgcagcguggcgcuggugccccacgugggcauggggcuggagacccggacggagaccuggauguccagcgagggcgccuggaagcacgcccagcgcaucgagaccuggauccuccggcacccgggguucaccaucauggccgccauccuggcguacacgaucggcaccacccacuuccagcgcgugcugaucuucauccuccugaccgccgucgcccccuccaugacgaugcggugcaucgggaucgccaaccgcgacuucguggagggcgugagcggcggguccugggucgacaucgugcuggagcacggcagcugcgugaccaccauggcgaagaacaagcccacccucgacuucgagcugaucaagacggaggccaagcagcccgccacccugcggaaguacugcaucgaggccaagcucaccaacaccacgaccgacucccgcugccccacccagggggagcccagccugaacgaggagcaggacaagcgguucgucugcaagcacuccaugguggaccgcggcuggggcaacgggugcggccuguucgggaagggcgggaucgugaccugcgccauguucacgugcaagaagaacaugaagggcaagaucguccagcccgagaaccucgaguacaccaucgugaucacgccccacagcggcgaggagcacgcgguggggaacgacaccggcaagcacgggaaggaggucaagaucaccccgcaguccagcaucacggaggccgagcugaccggcuacgggaccgugaccauggagugcagcccccggacgggccuggacuucaacgagauggugcuccugcagauggaggacaaggccuggcugguccaccgccagugguuccucgaccugccccugcccuggcucccgggcgccgacacccaggggagcaacuggauccagaaggagacccuggugaccuucaagaacccccacgccaagaagcaggacguggucgugcugggcucccaggagggggcgaugcacacggcccucaccggcgccaccgagauccagaugagcagcgggaaccugcuguucaccggccaccucaagugccggcugcgcauggacaagcugcagcucaagggcauguccuacagcaugugcacggggaaguucaaggucgugaaggagaucgccgagacccagcacggcaccaucgugauccggguccaguacgagggggacggcucccccugcaagauccccuucgagaucauggaccuggagaagcgccacgugcugggccggcucaucaccgugaacccgaucgucacggagaaggaccgccccgugaacaucgaggccgagccgcccuucggggacagcuacaucaucaucggcguggagccggggcagcugaagcugaacugguucaagaagggcuccagcaucgggcagauguucgagaccaccaugcgcggcgcgaagcggauggccauccucggcgacaccgccugggacuucgggucccugggcggggucuucacgagcaucggcaaggcccugcaccagguguucggggccaucuacggcgcggccuucuccggcgugagcuggaccaugaagauccucaucggggucaucaucaccuggaucggcaugaacucccgcagcaccucccugagcgugucccuggugcuggucgggaucgugacgcucuaccugggcgugaugguccaggccgacagcgggugcgugguguccuggaagaacaaggagcugaagugcggcaacggcaucuucgucaccgacaacgugcacaccuggaccgagcaguacaaguuccagcccgagagccccuccaagcucgccagcgcgauccagaaggcccacgaggaggggaucugcggcauccggagcgugacgcgccuggagaaccugauguggaagcagaucacccccgagcucaaccacauccuguccgagaacgaggucaagcugaccaucaugaccggggacaucaagggcaucaugcaggucgggaagcggagccuccagccgcagcccacggagcugcgcuacuccuggaagaccuggggcaaggccaagaugcugagcaccgagcuccacaaccagaccuuccugaucgacggccccgagacggccgagugcccgaacaccaaccgggccuggaacucccuggagguggaggacuacggguucggcgucuucaccaccaacaucuggcucaagcugcgcgagaagcaggacguguucugcgacagcaagcugauguccgcggccaucaaggacaaccgggccgugcacgccgacaugggguacuggaucgagagcgcccucaacgacaccuggaagaucgagaaggcguccuucaucgaggucaagagcugccacuggcccaagucccacacgcuguggagcaacggcgugcuggaguccgagaugaucauccccaagaaccucgccggccccgugagccagcacaacaaccgcccgggguacuacacccagaccgccggccccuggcaccuggggaagcuggagauggacuucgacuucugcaagggcaccacggucguggugaccgaggacugcgggaaccggggccccucccuccgcaccaccacggccagcggcaagcugaucaccgaguggugcugccgguccugcacccugcccccgcuccgcuaccgcggggaggacggcugcugguacgggauggagauccgcccccugaaggagaaggaggagaaccuggucaacagccucgugaccgccggccacgggcagaucgacaacuucagccugggcauccugggcauggcccucuuccuggaggagaugcugcggacgcgcguggggaccaagcacgccauccuccuggucgccguguccuucgugacccugaucaccggcaacaugagcuuccgggaccucgggcgcgucaucgugauggugggcgccacgaugaccgacgacaucgggaugggcgucaccuaccuggcgcugcucgccgccuucaaggugcgccccaccuucgccgccggccugcugcuccggaagcugacguccaaggagcugaugaugaccaccaucgggaucgugcuccugagccaguccagcauccccgagaccauccuggagcucacggacgcgcuggcccugggcaugaugauccucaagaugguccgcaacauggagaaguaccagcuggccgugaccaucauggccauccugugcgugccgaacgccgucauccuccagaacgcguggaagguguccugcaccauccuggccgucgugagcgugagcccccugcuccugaccagcucccagcagaaggccgacuggauccccaucgcccugacgaucaaggggcucaaccccaccgccaucuuccugaccacccugagccggacguccaagaagcgcagcuggccgcucaacgaggcgaucauggccgucggcaugguguccauccuggccagcucccugcucaagaacgacauccccaugaccggcccccugguggccgggggccugcucaccgucugcuacgugcugaccgggcggagcgcggaccuggagcucgagcgcgccgccgacgugaagugggaggaccaggccgagaucuccggcagcagccccauccuguccaucacgaucagcgaggacggguccaugagcaucaagaacgaggaggaggagcagacccugaccauccucauccggaccggccugcuggucguguccggccucuucccggugagcguccccaucaccgccgcggccugguaccugugggaggugaagaagcagcgcgccggggugcugugggacguccccagcccgccgcccgccggcaaggccgagcucgaggacggggcguaccggaucaagcagaagggcauccugggguacagccagaucggcgccggcguguacaaggaggggacguuccacaccauguggcacgugacccgcggcgccguccugaugcacaaggggaagcggaucgagcccuccugggccgacgugaagaaggaccucaucagcuacggcgggggcuggaagcuggagggcgaguggaaggagggggaggaggugcagguccuggcccucgagcccggcaagaacccccgcgcggugcagaccaagcccgggcuguucaagacgaacaccggcaccaucggggccgugucccuggacuucagccccggcaccuccggcagccccaucgucgacaagaaggggaagguggugggccucuacgggaacggcgucgugacgcgguccggcgccuacgugagcgccaucgcccagaccgagaaguccaucgaggacaaccccgagaucgaggacgacaucuuccgcaagcggcgccugaccaucauggaccugcaccccggggcgggcaagaccaagcgguaccugcccgccaucguccgcgaggccaucaagcgggggcuccgcacgcugauccuggccccgacccgggugguggcggccgagauggaggaggcccuccgcggccugcccguccgcuaccagacccccgccauccgggccgagcacaccgggcgcgagaucguggaccugaugugccacgcgacguucaccaugcggcuccugagccccauccgcgugccgaacuacaaccugaucaucauggacgaggcccacuucaccgaccccgccuccaucgccgcccggggcuacaucagcacccgcgucgagaugggcgaggcggccgggaucuucaugacggccacgccgcccggcagccgggacccguucccccaguccaacgcccccaucauggacgaggagcgcgagauccccgagcggagcuggaacuccgggcacgagugggugaccgacuucaagggcaagaccgugugguucgucccgagcaucaagacggggaacgacaucgccgcgugccuccgcaagaacggcaagcgggugauccagcugucccgcaagaccuucgacagcgaguacaucaagacccggaccaacgacugggacuucguggucacgaccgacaucuccgagaugggcgccaacuucaaggcccagcgcgugaucgacccccggcgcugcaugaagcccgugauccugaccgacggggaggagcgggucauccucgccggccccaugccggugacccacagcuccgcggcccagcgcgggcgggugggccgcaaccccaagaacgagaacgaccaguacaucuacaugggggagccccuggagaacgacgaggacugcgcccacuggaaggaggccaagaugcugcucgacaacaucaacacgcccgagggcaucaucccgagcauguucgagcccgagcgcgagaaggucgacgccaucgacggcgaguaccggcugcgcggggaggcgcggaagaccuucguggaccugaugcgccggggcgaccuccccguguggcuggccuacaaggucgccgccgaggggaucaacuacgccgaccgccgguggugcuucgacggcacccgcaacaaccagauccuggaggagaacguggaggucgagaucuggaccaaggagggggagcggaagaagcucaagccgcgcuggcuggacgcgcggaucuacgccgacccccuggcccucaaggaguucaaggaguucgccgccggccgcaagucccugacgcugaaccucaucaccgagaugggccggcugcccaccuucaugacccagaaggugcgcgacgcgcuggacaaccucgccgugcugcacacggccgaggccgggggcaaggcguacaaccacgcccugaacgagcuccccgagacccuggagacccugcuccugcugacccuccuggccaccgucaccggcgggaucuuccuguuccucaugagcgggcgggggaucggcaagaugacccuggggaugugcugcaucaucaccgccuccauccugcucugguacgcccagauccagccgcacuggaucgcggccagcaucauccuggaguucuuccugaucgugcuccugauccccgagcccgagaagcagcgcacgccccaggacaaccagcugacguacguggucaucgccauccucaccgugguggccgccaccauggcgaacgagaugggcuuccuggagaagaccaagaaggaccuggggcucggcuccaucgucacgcagcagccggagagcaacauccuggacaucgaccugcggcccgccuccgccuggacccucuacgccguggccaccaccuucaucacgcccaugcugcgccacagcaucgagaacuccagcgugaacgucagccugaccgcgaucgccaaccaggccaccgugcucaugggccuggggaagggcuggccccuguccaagauggacaucggggugccgcuccuggccaucggcugcuacagccaggucaaccccaucacccugacggccgcccucuuccugcugguggcccacuacgccaucaucgggcccggccuccaggccaaggcgacccgggaggcccagaagcgcgccgccgccggcaucaugaagaaccccaccguggacgggaucaccgucaucgaccuggacccgauccccuacgaccccaaguucgagaagcagcugggccaggugaugcuccuggugcugugcgucacgcagguccucaugaugcggaccaccugggcgcugugcgaggcccugacccucgccacggggcccguguccacccugugggagggcaacccggggcgcuucuggaacaccaccaucgccgucagcauggccaacaucuuccgcggcuccuaccuggcgggcgccgggcuccuguucagcaucaugaagaacacgaccuccgcccggcgcggcaccgggaacaucggcgagacccugggcgagaaguggaagucccggcucaacgcccuggggaaguccgaguuccagaucuacaagaaguccggcauccaggagguggaccgcacgcuggccaaggaggggaucaagcggggcgagaccgaccaccacgcggugucccgcgggagcgccaagcuccggugguucgucgagcgcaaccuggugacccccgagggcaagguggucgaccugggcugcgggcggggcgggugguccuacuacugcggcgggcucaagaacgugcgcgaggugaagggccugaccaagggcgggcccggccacgaggagcccaucccgaugagcacguacggguggaaccugguccggcuccaguccggcguggacguguucuucaucccgcccgagcgcugcgacacccugcugugcgacaucggggagagcucccccagcccgaccgucgaggccggccggacccuccgcgugcugaaccugguggagaacuggcucuccaacaacacccaguucugcgucaaggugcugaaccccuacaugcccagcgugaucgagaagauggaggcccugcagcggaagcacggcggggcgcugguccgcaacccgcucagccggaacuccacgcacgagauguacugggugagcaacgccuccggcaacaucgugagcuccgucaacaugaucagccgcaugcugaucaaccgguucaccaugcgccacaagaaggccaccuacgagcccgacguggaccugggguccggcacccgcaacaucgggaucgagagcgagacgcccaaccucgacaucaucggcaagcggaucgagaagaucaagcaggagcacgagaccuccuggcacuacgaccaggaccaccccuacaagaccugggccuaccacggcagcuacgagaccaagcagacgggguccgccagcuccauggugaacggcgucgugcgccugcugaccaagccgugggacgugguccccauggugacccagauggcgaugaccgacacgacccccuucgggcagcagcgggucuucaaggagaagguggacacccgcacccaggagcccaaggagggcacgaagaagcucaugcggaucaccgccgaguggcuguggaaggagcugggcaagaagaagaccccgcgcaugugcacccgggaggaguucacgaagaaggugcgcagcaacgccgcccucggggccaucuucaccgacgagaacaaguggaaguccgcgcgggaggccgucggcgacgggcgcuucugggagcugguggacaaggagcggaaccugcaccucgagggcaagugcgagaccugcguguacaacaugauggggaagcgcgagaagaagcugggcgaguucggcaaggccaaggggagccgggccaucugguacauguggcugggcgcccgcuuccucgaguucgaggcgcugggguuccugaacgaggaccacugguucucccgggagaacagccucuccggcgucgagggggagggccugcacaagcugggcuacauccuccgcgaggugagcaagaaggagggcggcgccauguacgccgacgacaccgccgggugggacacgcggaucaccaucgaggaccugaagaacgaggagaugaucaccaaccacauggagggcgagcacaagaagcuggcggaggccaucuuccgccucaccuaccagaacaaggugguccgggugcagcgccccacgccccgggggaccgugauggacaucaucagccgccgcgaccagcggggcuccggccaggucgggaccuacggccugaacaccuucacgaacauggaggcccagcugauccgccagauggagggggagggcguguucaagagcauccagcaccucaccgccgccgaggagaucgcggugcagaacuggcugguccgggugggccgcgagcggcugucccgcauggccaucagcggggacgacugcguggucaagccccucgacgaccgguucgcccgcgcccugaccgcccugaacgacaugggcaaggugcggaaggacauccagcagugggagccgucccgcggguggaacgacuggacccaggugcccuucugcagccaccacuuccacgagcucaucaugaaggacggccggauccuggucgugcccugccgcaaccaggacgagcugaucgggcgggcgcgcaucucccagggcgccggcuggagccuccgggagacggccugccuggggaaguccuacgcccagauguggagccugauguacuuccaccgccgggaccuccgccuggccgcgaacgccaucugcuccgccgugcccagccacugggucccgaccucccggaccaccuggagcauccacgccucccacgaguggaugaccacggaggacaugcugaccguguggaaccgcguguggauccaggagaaccccuggauggaggacaagacccccgucgagagcugggaggagauccccuaccucggcaagcgcgaggaccaguggugcgggucccugaucggccugaccagccgggccacgugggcgaagaacauccagaccgccaucaaccaggugcgcagccucaucgggaacgaggaguacaccgacuacaugccguccaugaagcgguuccgccgggaggaggaggaggccggcgugcugugguga

SEQ ID NO: 9764 - RNA, 9876 nt, Artificial Sequence
  derived and/or modified CDS sequence (opt1) from DENV-2__KF479233__SS-prME
accgccggggugaucaucaugcugauccccaccgccauggcguuccaccucaccacccggaacggggagccccacaugaucgucagccggcaggagaagggcaagagccugcuguucaagaccgaggacggggugaacaugugcacccucauggccauggaccugggggagcugugcgaggacaccaucaccuacaacugcccccuccugcgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcucgagacccgcaccgagaccuggauguccagcgagggcgccuggaagcacgcgcagcggaucgagaccuggauccugcgccaccccggguucacgaucauggccgccauccuggccuacaccaucggcaccaccuacuuccagcggguccucaucuucauccugcugacggcgguggcccccuccaugaccaugcgcugcaucgggaucagcaaccgggacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccgcaaguacugcaucgaggcgaagcugaccaacacgaccaccgccagccggugcccgacccagggggagcccucccugaacgaggagcaggacaagcgcuucgugugcaagcacagcaugguggaccggggcuggggcaacgggugcggccucuucgggaagggcgggaucgucacgugcgccauguucacgugcaagaagaacauggagggcaagaucgugcagcccgagaaccuggaguacaccaucguggucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccucgacuucaacgagauggugcugcugcagauggagaacaaggcguggcucgugcaccggcagugguuccuggaccugccccuccccuggcugccgggcgccgacacccagggguccaacuggauccagaaggagacccuggucacguucaagaacccccacgccaagaagcaggacguggucgugcucggcagccaggagggggccaugcacaccgcccugaccggcgcgaccgagauccagaugagcuccgggaaccuccuguucacgggccaccugaagugccgccugcggauggacaagcuccagcugaagggcaugagcuacuccaugugcaccgggaaguucaagguggucaaggagaucgccgagacccagcacggcaccaucguggugcgcguccaguacgagggggacggcagccccugcaagauccccuucgagaucauggaccuggagaagcggcacgugcucggccgccugaucacggugaacccgaucgucaccgagaaggacucccccgugaacaucgaggccgagccgcccuucggggacagcuacaucaucaucggcguggagccggggcagcugaagcucuccugguucaagaagggcagcuccaucgggcagauguucgagaccaccaugcgcggcgccaagcggauggccauccugggcgacacggcgugggacuucgggagccugggcggggucuucaccuccaucggcaaggcccuccaccagguguucggggccaucuacggcgccgcguucagcggcguguccuggaccaugaagauccugaucggggucgugaucaccuggaucggcaugaacagccgcuccacgagccuguccgugagccugguccucguggggguggucacccuguaccugggcgugauggugcaggccgacuccgggugcgucgugagcuggaagaacaaggagcucaagugcggcagcggcaucuucaucaccgacaacgugcacaccuggacggagcaguacaaguuccagcccgagucccccagcaagcuggccuccgccauccagaaggcccacgaggaggggaucugcggcauccggagcgucacccgccuggagaaccucauguggaagcagaucacccccgagcugaaccacauccuguccgagaacgaggugaagcucaccaucaugacgggggacaucaagggcaucaugcaggcggggaagcggagccugcgcccgcagcccaccgagcugaaguacuccuggaagaccuggggcaaggccaagaugcucagcaccgagccccagaaccagacguuccugaucgacggcccggagaccgccgagugccccaacaccaaccgggccuggaacucccuggagguggaggacuacggguucggcgucuucaccacgaacaucuggcucaagcugaaggagcgccaggacguguucugcgacagcaagcugauguccgccgcgaucaaggacaaccgggccgugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggcccggugagccagcacaacuaccgccccggguaccacacccagaccgccggccccuggcaccucgggaagcuggagauggacuucgacuucugcgagggcacgaccgucguggugaccgaggacugcgggaaccggggccccagccugcgcaccacgaccgccuccggcaagcucaucaccgaguggugcugccggagcugcacccugccgccccugcgcuacaagggggaggacggcugcugguacgggauggagauccggccccucaaggagaaggaggagaaccuggucaacucccuggugacggccggccacgggcagaucgacaacuucagccucggcgugcugggcauggcgcuguuccucgaggagaugcugcgcacccgggucgggaccaagcacgccgugcugcucguggccgucuccuucaugacccugaucacgggcaacaugagcuuccgcgaccuggggcgggugauggugauggucggcgccgccaugaccgacgacaucgggaugggcgugaccuaccucgcgcugcuggccgccuucaaggugcgccccaccuucgccgccggccuccugcugcgcaagcucacguccaaggagcugaugaugaccaccaucgggaucguccugcucagccaguccaccaucccggagacgauccuggagcugaccgacgcgcucgcccugggcaugaugauccugaagaucgugcggaacauggagaaguaccagcucgccgucaccaucauggccauccugugcgugcccaacgccgugauccugcagaacgcguggaaggucagcugcaccauccucgccgugguguccgucagcccccugcugcucacguccagccagcagaaggccgacuggaucccccuggcccugaccaucaaggggcucaacccgaccgcgaucuuccugaccacgcugucccgcaccaacaagaagcggagcuggccccucaacgaggccaucauggccgugggcaugguguccauccuggccagcucccugcucaagaacgacauccccaugaccggcccccuggucgccgggggccugcucaccgugugcuacgugcugacggggcgcagcgcggaccuggagcucgagcgggccgccgacguccgcugggaggaccaggccgagaucagcggcuccagcccgauccuguccaucaccaucagcgaggacggguccaugagcaucaagaacgaggaggaggagcagacccugaccauccucauccggacgggccugcuggugaucuccggccucuuccccgugagcauccccaucaccgccgcggccugguaccugugggaggucaagaagcagcgcgccggggugcugugggacgugcccuccccgccgcccgucggcaaggccgagcucgaggacggggccuaccggaucaagcagaagggcauccugggguacagccagaucggcgcgggcguguacaaggaggggaccuuccacaccauguggcacgugacccgcggcgccguccugaugcacaaggggaagcggaucgagccguccugggccgacgugcgcaaggaccucaucagcuacggcgggggcuggaagcuggagggcgaguggaaggagggggaggaggugcagguccuggcccucgagcccggcaagaacccccgggccgugcagacgaagcccgggcuguucaagaccaacaccggcaccaucggggcggugucccuggacuucagcccgggcacguccggcagccccaucgucgacaagaaggggaagguggugggccucuacgggaacggcgucgugacccgcuccggcaccuacgugagcgccaucgcccagaccgagaaguccaucgaggacaaccccgagaucgaggacgacaucuuccggaagaagcgccugacgaucauggaccugcaccccggggccggcaagaccaagcgguaccugccggcgaucguccgcgaggccaucaagcgggggcuccgcacccugauccuggcccccacccgggugguggccgccgagauggaggaggcgcuccgcggccugcccauccgcuaccagacgcccgccauccgggccgagcacaccgggcgcgagaucgucgaccugaugugccacgccaccuucaccaugcggcuccugagcccggugcgcgugcccaacuacaaccugaucaucauggacgaggcccacuucacggaccccgcgagcaucgccgcccggggcuacaucuccacccgcgucgagaugggcgaggccgccgggaucuucaugaccgcgacgccgcccggcagccgggaccccuucccccaguccaacgcccccaucauggacgaggagcgcgagauccccgagcggagcuggaacuccgggcacgagugggugacggacuucaagggcaagaccgugugguucguccccagcaucaaggccgggaacgacaucgccgcgugccuccgcaagaacggcaagaaggugauccagcugucccggaagaccuucgacagcgaguacaucaagacccgcacgaacgacugggacuucguggucaccaccgacaucuccgagaugggcgccaacuucaaggccgagcgggugaucgacccccgccggugcaugaagcccgugauccugaccgacggggaggagcgcgucauccucgccggcccgaugcccgugacgcacagcuccgccgcgcagcggcgcgggcggaucggccgcaaccccaagaacgagaacgaccaguacaucuacaugggggagccccuggagaacgacgaggacugcgcccacuggaaggaggccaagaugcugcucgacaacaucaacaccccggagggcaucauccccagcauguucgagcccgagcgcgagaagguggacgccaucgacggcgaguaccggcugcgcggggaggcccggaagaccuucgucgagcugaugcgccggggcgaccucccgguguggcuggcguaccgcgucgccgccgaggggaucaacuacgccgaccggcgcuggugcuucgacggcaucaagaacaaccagauccuggaggagaacguggagguggagaucuggaccaaggagggggagaagaagaagcucaagccccgguggcuggacgcccgcaucuacuccgacccccuggcgcucaaggaguucaaggaguucgccgccggccgcaagagccugacgaugaaccugaucaccgagaugggccgccuccccaccuucaugacccagaaggcccggaacgcgcuggacaaccuggccguccuccacacggccgaggccgggggccgcgccuacaaccacgcgcuguccgagcugccggagacccucgagacccugcugcuccugacccugcucgccacggugaccgggggcaucuuccuguuccugaugagcggcaaggggaucggcaagaugacccucgggaugugcugcaucaucaccgccuccauccugcugugguacgcccagauccagccccacuggaucgccgcgagcaucauccucgaguucuuccugaucgugcugcucauccccgagcccgagaagcagcggaccccgcaggacaaccagcugacguacgucgugaucgccauccugaccguggucgccgccaccauggccaacgagaugggcuuccucgagaagaccaagaaggacuucgggcugggcuccaucgugacgcagcagcccgagagcaacauccuggacaucgaccuccgccccgcgagcgccuggacccuguacgccguggccaccaccuucaucacgcccaugcugcggcacuccaucgagaacagcuccgucaacgugagccucaccgccaucgcgaaccaggccaccgugcugaugggccuggggaagggcuggccgcucuccaagauggacaucggggucccccugcuggccaucggcugcuacagccaggugaaccccaucacccucacggccgcgcugcugcuccugguggcccacuacgccaucaucgggcccggccugcaggccaaggccacccgcgaggcgcagaagcgggccgccgccggcaucaugaagaacccgaccgucgacgggaucaccgugaucgaccucgaccccauccccuacgaccccaaguucgagaagcagcugggccaggugaugcugcucguccugugcgugacccaggugcugaugaugcgcaccaccugggcccucugcgaggcgcugacccuggccacggggccgaucuccacccucugggagggcaaccccgggcgguucuggaacaccaccaucgccgucagcauggccaacaucuuccgcggcuccuaccuggccggcgcggggcuccuguucagcaucaugaagaacacggccaacacccgccggggcaccgggaacaccggcgagacgcugggcgagaaguggaagaaccgccugaacucccucggcaagagcgaguuccagaucuacaagcgguccggcauccaggagguggaccgcacccuggccaaggaggggaucaagcggggcgagaccgaccaccacgccgugagccgcggguccgcgaagcugcggugguucgucgagcgcaaccucgugacccccgagggcaaggugauggaccugggcugcgggcggggcggguggagcuacuacugcggcgggcugaagaacguccgcgaggugaagggccucacgaagggcgggcccggccacgaggagccgauccccauguccaccuacggguggaaccuggugcggcugcagagcggcgucgacguguucuucacgccgcccgagaagugcgacacccuccugugcgacaucggggaguccagcccgaaccccacgguggaggccggccgcacccugcggguccucaaccugguggagaacuggcugaacaacaacacccaguucugcaucaaggugcucaaccccuacaugccgagcgucaucgagaagauggagacccugcagcgcaaguacggcggggcccuggugcggaacccccugucccgcaacagcacccacgagauguacuggguguccaacgccagcggcaacaucgucuccagcgugaacaugaucucccggaugcucaucaaccgcuucacgaugcggcacaagaaggccaccuacgagcccgacguggaccuggggagcggcacccgcaacaucgggaucgaguccgagauccccaaccuggacaucaucggcaagcgcaucgagaagaucaagcaggagcacgagaccagcuggcacuacgaccaggaccacccguacaagacgugggcguaccacggcuccuacgagaccaagcagaccgggagcgccuccagcauggucaacggcguggugcggcuccugaccaagcccugggacgucauccccauggugacgcagauggccaugaccgacaccacccccuucgggcagcagcgcguguucaaggagaaggucgacacgcggacccaggagccgaaggagggcaccaagaagcugaugaagaucaccgccgaguggcucuggaaggagcugggcaagaagaagacgccccgcaugugcacccgggaggaguucacccgcaaggugcgguccaacgccgcgcugggggccaucuucaccgacgagaacaaguggaaguccgcccgcgaggccgucgaggacucccgguucugggagcucguggacaaggagcgcaaccugcaccuggagggcaagugcgagacgugcguguacaacaugauggggaagcgggagaagaagaucggcgaguucgggaaggccaagggcagccgcgcgaucugguacauguggcucggcgcccgguuccuggaguucgaggcccugggguuccucaacgaggaccacugguucucccgcgagaacagccugagcggcgucgagggggagggccugcacaagcucggguacauccugcgggagguguccaagaaggagggcggcgccauguacgcggacgacaccgccgggugggacacccgcaucacccuggaggaccucaagaacgaggagauggugacgaaccacauggagggcgagcacaagaagcuggccgaggccaucuucaagcugaccuaccagaacaaggucgugcgggugcagcgccccacgccccgggggaccgucauggacaucaucagccgccgggaccagcgcggcuccggccaggugggcacguacggccucaacaccuucaccaacaugggggcccagcugauccgccagauggagggcgaggggguguucaagagcauccagcaccugaccacgaccgaggaggucgcggugcaggacuggcucgcccgggugggccgcgagcggcugucccgcauggccaucagcggcgacgacugcgucgugaagccgcuggacgaccgguucgccuccgcccucaccgcgcugaacgacauggggaaggugcgcaaggacauccagcagugggagcccagccggggcuggaacgacuggacccagguccccuucugcucccaccacuuccacgagcugaucaugaaggacgggcgcgugcucgugguccccugccggaaccaggacgagcugaucggccgcgcccggaucagccagggggccggcuggucccugcgcgagacggccugccucggcaagagcuacgcccagauguggucccugauguacuuccaccggcgcgaccugcggcucgcggccaacgccaucugcagcgccgugccgucccacugggugcccaccagccgcaccaccugguccauccacgcccggcacgaguggaugaccacggaggacaugcugaccgucuggaaccgcguguggauccaggagaaccccuggauggaggacaagacccccguggagagcugggaggagaucccguaccuggggaagcgggaggaccaguggugcggcagccucaucgggcugaccucccgcgcgacgugggccaagaacauccagaccgccaucaaccagguccgcagccugaucggcuccgaggaguacaccgacuacaugcccagcaugaagcgguuccgccgggaggaggaggaggccggggugcucugguga

SEQ ID NO: 9765 - RNA, 9876 nt, Artificial Sequence
  derived and/or modified CDS sequence (opt1) from DENV-2__KX372564__SS-prME
accgccgggaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggggagcugugcgaggacaccaucaccuacaacugcccccugcuccgccagaacgagcccgaggacaucgacugcuggugcaacagcaccagcaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucacgaucauggcggccauccuggccuacaccaucggcaccaccuacuuccagcgggugcugaucuucauccuccugacggccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccugaccgagaacgaggucaagcugacgaucaugaccggggacaucaagggcaucaugcaggccgggaagcggucccuccgcccgcagcccaccgagcugaaguacagcuggaaggcguggggcaaggccaaggugcuguccaccgagcuccacaaccacacguuccugaucgacggccccgagaccgccgagugcccgaacaccaaccgggccuggaacagccuggagguggaggacuacggguucggcgucuucaccacgaacaucuggcucaagcugaaggagcgccaggacguguccugcgacagcaagcugauguccgccgcgaucaaggacaaccgggccgugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggcggcuggagauggacuucgacuucugcgagggcacgaccgucguggugaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggucaacucccuggugacggccggccacgggcagaucgacaacuucagccucggcgugcugggcauggcgcuguuccucgaggagaugcugcgcacccgggucgggaccaagcacgccauccugcucguggccguguccuucgucacccugaucacgggcaacaugagcuuccgcgaccuggggcgcgugauggugauggucggcgccaccaugaccgacgacaucgggaugggcgugaccuaccucgcccugcuggcggccuucaaggugcggcccacguucgccgccggccuccugcugcgcaagcucaccuccaaggagcugaugaugaccaccaucgggaucguccugcucagccaguccacgauccccgagaccauccuggagcugaccgacgcccucgcgcugggcaugauggugcugaagaucguccggaacauggagaaguaccagcucgccgugaccaucauggccauccugugcgugccgaacgccgucauccugcagaacgccuggaaggugagcugcacggcgcucgccguggucuccgugagcccccugcugcucaccuccagccagcagaagaccgacuggaucccccuggcccugaccaucaaggggcucaaccccacggccaucuuccugaccacccugucccgcaccagcaagaagcgguccuggccgcucaacgaggcgaucauggccgugggcauggucagcauccuggccuccagcuuccugaagaacgacauccccaugacgggcccccucguggccgggggccugcugaccgugugcuacguccucaccgggcgcagcgccgaccuggagcuggagcgggcggccgacauccgcugggaggagcaggccgagaucuccggcagcucccccauccucagcaucaccaucuccgaggacgggagcauguccaucaagaacgaggaggaggagcagacgcugaccauccugauccggaccggccuccuggugaucagcggccuguucccgguguccauccccaucaccgccgccgcgugguaccucugggaggucaagaagcagcgcgccggggugcugugggacgugcccagcccgccgcccgucggccgggccgagcuggaggacggggccuaccgcaucaagcagaagggcauccucggguacucccagaucggcgccggcguguacaaggaggggaccuuccacacgauguggcacgugacccggggcgcgguccugaugcacaaggggaagcgcaucgagcccagcugggccgacgugaagaaggaccugaucuccuacggcgggggcuggaagcucgagggcgaguggaaggagggggaggaggugcagguccuggcccuggagcccggcaagaacccccgggccgugcagaccaagcccggccuguucaagaccaacacgggcaccaucggggccgugagccuggacuucucccccggcaccagcggcucccccaucgucgacaagaaggggaagguggugggccuguacgggaacggcgucgugacccgcagcggcacguacguguccgcgaucgcccagaccgagaaguccaucgaggacaaccccgagaucgaggacgacaucuuccggaagaagcgccucaccaucauggaccugcaccccggggccggcaagaccaagcgguaccugcccgccaucguccgcgaggcgaucaagcgggggcugcgcacgcucauccuggccccgacccgcgugguggccgccgagauggaggaggcccugcggggccuccccauccgcuaccagacccccgcgauccgggccgagcacaccgggcgcgagaucgucgaccugaugugccacgccacguucaccaugcggcugcucagccccauccgcgugccgaacuacaaccugaucaucauggacgaggcccacuucaccgaccccgccuccaucgcggcccggggcuacaucagcacccgcguggagaugggcgaggccgccgggaucuucaugacggccacgccgcccggcucccgggacccguucccccagagcaacgcgcccaucauggacgaggagcgcgagauccccgagcgguccuggaacagcgggcacgagugggucaccgacuucaagggcaagaccgugugguucgugccguccaucaaggccgggaacgacaucgccgccugccugcgcaagaacggcaagaaggucauccagcucagccggaagacguucgacuccgaguacaucaagacccgcaccaacgacugggacuucguggugaccacggacaucagcgagaugggcgcgaacuucaaggccgagcgggucaucgacccccgccggugcaugaagcccgugauccugaccgacggggaggagcgcgugauccuggccggccccaugccggucacccacuccagcgccgcccagcggcgcgggcgcgugggccggaaccccaagaacgagaacgaccaguacaucuacaugggggagccccucgagaacgacgaggacugcgcgcacuggaaggaggccaagaugcugcuggacaacaucaacacccccgagggcaucaucccguccauguucgagcccgagcgcgagaagguggacgccaucgacggcgaguaccggcuccgcggggaggcccggaagacguucgucgaccugaugcgccggggcgaccugcccguguggcucgccuaccgcgucgcggccgaggggaucaacuacgccgaccggcgcuggugcuucgacggcgugaagaacaaccagauccuggaggagaacguggaggucgagaucuggaccaaggagggggagcggaagaagcugaagccgcgcuggcucgacgcccggaucuacagcgacccccuggcccugaaggaguucaaggaguucgcggccggccgcaagucccucacccugaaccugaucaccgagaugggccggcuccccacguucaugacccagaaggcccgcaacgcccuggacaaccuggcggugcuccacaccgccgaggccgggggccgggccuacaaccacgcccugagcgagcugcccgagacccucgagacgcugcugcuccugacccugcucgcgaccgugaccgggggcaucuuccuguuccugauguccggcaaggggaucggcaagaugacccucgggaugugcugcaucgucacggccagcauccugcugugguacgcccagauccagccgcacuggaucgccgccuccaucauccucgaguucuuccugaucgugcugcucauccccgagcccgagaagcagcgcacgccccaggacaaccagcugaccuacguggucaucgcgauccugaccgugguggccgccacgauggccaacgagaugggcuuccucgagaagaccaagaaggacuucgggcugggcagcaucaccacccagcagccggagagcaacauccuggacaucgaccuccggcccgccuccgcguggacgcuguacgccgucgccaccaccuucaucacccccaugcugcgccacagcaucgagaacuccagcgugaacgugucccucacggccaucgccaaccaggcgaccguccugaugggccuggggaagggcuggccccucagcaagauggacaucggggugccgcugcuggccaucggcugcuacucccaggugaaccccaucacccucaccgccgcccugcugcuccuggucgcgcacuacgccaucaucgggcccggccugcaggccaaggccacgcgggaggcccagaagcgcgcggccgccggcaucaugaagaaccccaccguggacgggaucaccgugaucgaccucgacccgauccccuacgaccccaaguucgagaagcagcugggccaggucaugcugcucgugcugugcgugacccagguccugaugaugcgcacgaccugggcccucugcgaggcccugacccuggcgaccgggcccaucagcacgcucugggagggcaacccggggcgguucuggaacaccaccaucgccguguccauggccaacaucuuccgcggcagcuaccuggccggcgccgggcuccucuucuccaucaugaagaacaccgcgaacacgcggcgcggcaccgggaacaccggcgagacccugggcgagaaguggaagaaccggcugaacgcccucggcaagagcgaguuccagaucuacaagaaguccggcauccaggagguggaccgcacgcuggccaaggaggggaucaagcggggcgagaccgaccaccacgccgucagccgcggguccgcgaagcugcggugguucguggagcgcaaccucgugacccccgagggcaaggucguggaccugggcugcgggcggggcggguggagcuacuacugcggcgggcugaagaacgugaaggaggucaagggccucaccaagggcgggcccggccacgaggagcccaucccgauguccacguacggguggaaccuggugcgccugcagagcggcguggacgucuucuucacgccgcccgagaagugcgacacccuccugugcgacaucggggaguccagccccaacccgaccguggaggccggccggacccugcgcgugcucaaccuggucgagaacuggcugaacaacaacacgcaguucugcaucaaggugcucaaccccuacaugcccagcgugaucgagaagauggaggcccugcagcggcgcuacggcggggcccugguccggaacccgcugucccgcaacagcacccacgagauguacuggguguccaacgccagcggcaacaucguguccagcgucaacaugaucucccggaugcucaucaaccgcuucaccaugcgccacaagaaggcgaccuacgagcccgacguggaccuggggagcggcacgcggaacaucgggaucgaguccgaggugcccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggucaacggcguggugcggcuccugaccaagccgugggacgucauccccauggugacccagauggccaugaccgacacgacccccuucgggcagcagcgcgucuucaaggagaagguggacacccggacccaggagcccaaggagggcacgaagaagcugaugaagaucaccgccgaguggcucuggaaggagcugggcaagaagaagaccccgcgcaugugcacccgggaggaguucacgcgcaaggugcgguccaacgcggcccugggggccaucuucaccgacgagaacaaguggaaguccgcccgcgaggccgucgaggacuccggcuucugggagcucguggacaaggagcggaaccugcaccuggaggggaagugcgagaccugcguguacaacaugaugggcaagcgcgagaagaagcucggggaguucggcaaggcgaagggcagccgggccaucugguacauguggcugggggcccgcuuccuggaguucgaggcccucggcuuccugaacgaggaccacugguucucccgggagaacagccugagcggggucgagggcgaggggcuccacaagcugggcuacauccugcgcgacguguccaagaaggagggcggggcgauguacgccgacgacaccgccggcugggacacgcggaucacccucgaggaccugaagaacgaggagauggugaccaaccacauggagggggagcacaagaagcuggccgaggccaucuuccgccucaccuaccagaacaaggucgugcgggugcagcgccccacgccccggggcaccgucauggacaucaucagccgccgcgaccagcggggguccggccagguggugaccuacggccugaacaccuucacgaacauggaggcgcagcugauccgccagauggagggggagggcgucuucaagagcauccagcaccucaccgccaccgaggagaucgccgugaagaacuggcuggugcgggucgggcgcgagcggcugucccgcauggccaucagcggcgacgacugcguggugaagcccuucgacgaccgguucgccaacgcgcucaccgcccugaacgacaugggcaagguccgcaaggacauccagcagugggagccgucccggggguggaacgacuggacccaggugcccuucugcagccaccacuuccacgagcugaucaugaaggacggccgcgugcucgucgugcccugccggaaccaggacgagcugaucgggcgcgcccggaucucccagggcgccggguggagccugcgcgagaccgccugccucggcaaguccuacgcgcagauguggagccugauguacuuccaccggcgcgaccugcggcucgccgccaacgccaucugcuccgccgugcccagccacugggucccgaccucccgcaccaccuggagcauccacgcgacgcacgaguggaugaccaccgaggacaugcugaccguguggaaccggguguggauccaggagaaccccuggauggaggacaagacgcccgucgaguccugggaggagauccccuaccugggcaagcgcgaggaccaguggugcgggagccucaucggccugaccagccgcgccaccugggccaagaacauccagaccgccaucaaccaggugcggucccugaucgggaacgaggaguacacggacuacaugccgagcaugaagcgcuuccggcgcgaggaggaggaggcgggcgugcucugguga

SEQ ID NO: 9766 - RNA, 9873 nt, Artificial Sequence
  derived and/or modified CDS sequence (opt1) from DENV-2__KX274130__SS-prME
agcgccgccacccugcugcugcuggugcccaccaucauggccuuccaccucaccacccggaacggcgagccgcacaugaucgucgcccggcacgagaaggggaagucccugaucuucaagaccgagaacggcgugaacaugugcacccugauggccauggaccucggggagcugugcgaggagaccgugaccuacaagugccccuaccugaagcagagcgagcccgaggacaucgacugcuggugcaacaccaccuccaccugggucaccuacgggaccugcagcuccagcggggagcaccgccgggagaagcgcuccguggcccucgcgccccacgugggcaugggccuggagacccggaccgagaccuggaugagcuccgagggggccuggaagcacgcccagcgcaucgagaacuggauccugcggcacccgggcuacaccgucauggccgccgccaucgccauggccaucgggaccaacaacuuccagcgcgcccucaucuucgugcugcugaccgccguggcgcccagcaugaccaugcggugcgucggcaucgccaaccgcgacuucguggaggggguguccggcggcagcugggucgacaucgugcucgagcacggguccugcgugaccaccauggccaagaacaagcccacgcuggacuucgagcugaccaagaccgaggccaagcuccccgccacccugcggaaguacugcaucgaggcgaagcugacgaacaccaccaccgagagccgcugcccgacgcagggcgagcccucccuccccgaggagcaggacaagcgguucaucugccgccacagccuggucgaccggggguggggcaacggcugcgggcuguucggcaagggcgggaucgugaccugcgccauguucacgugcaagaaguacauggaggggaagaucgugcagcccgagaaccucgaguacaccgucgccgugacgccgcacuccggcgaggagcacagcgugggcaacgacaccgggaagcacggccaggacgucaagaucacgccccaguccagcaucaccgagacggcccuggagggguacggcagcaucuccauggagugcagcccccgcaccgggcuggacuucaacgagauggugcuccugcagauggaggacaaggccuggcuggugcaccggcagugguuccucgaccugccccugccguggcuccccggcuccgacacccagggcagcaacuggguccagaaggagacccuggugaccuucaagaacccccacgcgaagaagcaggacgucguggugcuggggucccaggagggcgccaugcacagcgcccucacgggggccaccgagauccagaugaccuccggcaaccugcuguucaccgggcaccucaagugccgccugcggauggacaagcuggagcucaagggcaugagcuacuccaugugcacgggcaaguucaaggucgugaaggagaucgccgagacccagcacgggaccaucgugauccgcguccaguacgagggcgaggggagccccugcaagaucccguucgagaucauggaccuggagaagaagcacgugcugggccggcucaucaccgugaaccccaucaucacggagaaggacaagcccaccaacaucgaggcggagcccccguucggcgacuccuacauccugaucggggucgagcccggccagcugaagaugaacugguucaagaaggggagcuccaucggccagauguucgagaccaccaugcgcggggccaagcgcauggccauccucggcgacacggccugggacuucggcagccucggcgggguguucaacuccaucgggaaggcgcugcaccagguguucggggccgucuacaacgccgccuucagcgggguguccuggaccaugaagauccugaucggcgugaucaucaccuggaucggcaugaacagccgguccaccagcaugagcaucacgcucgucaugguggggcuggugacccuguaccucggcgucguggugcaggccgacuccgggugcgucgugagcuggaagaccaaggagcugaagugcggcuccgggaucuucgugaccgacaacguccacguguggacggagcaguacaaguuccagcccgagagccccgcgaagcuggccgccgccaucaagaaggcccacgaggagggcgugugcggcauccgcuccgucacccggcucgagaacaucauguggaagcagaucaccccggagcugaaccacauccugaccgagaacgacgugaaggugacgaucaugaccggggacaucaagggcauccuccagcaggggcgccgggcgcugcgcccccagcccaccgagcugaaguacagcuggaaguccuggggcaagagcaagaucgucuccagcgagacccacaaccagacguuccucaucgacgggccggagaccaccgagugccccgacaccaaccgggccuggaacucccuggagguggaggacuacggcuucggccuguucagcacgaacaucuggcuccgccugcgggagaagcaggacacccugugcgacuccaagcucaugagcgccgccgugaaggacgagcgcgccauccacgcggacaugggguacuggaucgaguccaagcugaacggcagcuggaagaucgagaaggccuccuuccuggaggucaagagcugcaccuggccccggagccacacccucugguccaacggggugcuggagagcgagaugaucauccccaagaaccugggcggcccggugucccagcacaacuaccgccccggguacuacacgcagaccaccggccccuggcaccucgggaagcuggagauggacuucgacuacugcgagggcaccaccgucaucgugacggaggagugcaacaaccgggggcccagccugcgcaccaccaccgccuccggcaagcucaucacggaguggugcugccggagcugcaccaugccgccccugcgcuucaagggcgaggacgggugcugguacggcauggagauccggccccugaaggagaaggaggagaaccucgugaacucccuggucaccgccgggcacggccagaucgacaacuucagccuggggauccucggcaucgcgcuguuccuggaggaggugaugaagucccgcaucggcaucaagcacaccaucgggaugacgaucaucaccuuccuccugcuggugaccggcaacgucagcuaccgggaccucgggcgcgugauccugauggugggcuccaccauggccgacgagauggggaugggcgucacguaccuggcccuccuggccaccuuccgcauccggcccaccuucgcccuggcgcucaugauccgcaagcugaccagcaaggagcugcucauggccacgaucggcaucgugcugaucgcccagugcgacgugccggggaccauccuggagaucaccgacgccugcgcccucggccugaugcugcucaagaugacccgggagcuggagcgcuaccagcuggcggucacgcuccugucccugaccugcauccccaacgccaccaucauguggggcgccuggaaggugaccugcacgauccucacccuggugagcauggcgccccuguuccucaccaccucccggcagaagacggacuggguccccguggcccugagcaucuacggccugaacccgaccgcgaucuacuucaccacccucgccaaggccaagaagauccgcuccuggccccugaacgaggccgucauggcggugggcauggugagcauccuggccuccagccuccugcggaacgacauccccauggccgggccccuggucgccggcgggcuccugacgcugugcuacgugcucaccggccgcagcgccgaccuggagcuggagaaguccgcggacaucaaguggaacgacgacgccgagaucagcggguccagcccgaucaucaacguggccgucuccgaggacggcagcauguccaucaaggacgaggaggaggagaacacccucaccauccugauccggacgggccugcucgccaucagcgggauguaccccauggccauccccgcgaccgccgccgugugguacuucugggaggcccgcaagcagcgggccggcgugcugugggacguccccuccccgccgcccaccgggaaggcggagcuggaggagggcgccuaccgcaucaagcagcgggggaucuucggcuacagccagaucggcgccgggguguacaaggagggcaccuuccacaccauguggcacgugacgcgcggguccguccucaugugcaagggcaagcggcuggagccgagcugggccgacgugaagaaggaccugaucuccuacgggggcggcuggcgccucgacggggaguggaccgagggcgaggaggugcagguccuggcccuggagcccgggaagaacccccgggcggugcagaccaagcccggcauguucaagaccgacacggggcgcaucggcgccgugagccucgacuucgccccgggcaccuccgggagccccaucaucgacaagaagggcaaggucaucgggcuguacggcaacggcguggugaugaaguccggggccuacgucagcuccaucgcgcagaccgagaagcgggaggacgagauccccgagaucgaggacgacaucuuccgcaagcggcgccugaccaucauggaccuccaccccggcgccgggaagacgaagcgcuaccugccggccaucgugcgggaggccaucaagcgcggccugcggacccugauccucgcccccacccgcguggucgcggccgagauggaggaggcccugcgggggcugcccauccgcuaccagacccccgccauccgggccgagcacacgggccgcgagaucguggaccucaugugccacgcgaccuucaccaugcggcugcugagcccggugcgcguccccaacuacaaccucaucaucauggacgaggcccacuucaccgaccccgccagcaucgccgcccggggcuacaucgcgacgcgcguggagaugggggaggccgccggcaucuucaugaccgccacgccgcccggguccaaggaccccuucccccagagcaacgcgcccaucauggacgaggagcgggagauccccgagcgcuccuggaacagcggccacgaguggaucaccgacuucgaggggaagacggugugguucguccccuccauccgggccggcaacgacaucgcgaccugccugcgcaagaacggcaagaaggugauccagcugagccggaagaccuucgacaccgaguacaucaagacgcgcaacaacgacugggacuucguggucaccaccgacaucuccgagaugggggccaacuucaaggccgagcgggugaucgacccccgccgcugcaugaagcccgugauccucaccgacggcgaggagcgggucauccuggcggggccgaugcccgugacgcccagcuccgccgcccagcgccggggccgcaucgggcggaaccccaagaacgagaacgaccaguacaucuacaugggcgagccgcuggagaacgacgaggacugcgcccacuggaaggaggccaagaugcuccuggacaacaucaacacccccgagggcaucauccccgcgauguucgggccggagcgcgagaagaccgacgccaucgacggcgaguaccggcugcgcggggagagccggaagaccuucguggagcucaugcgccggggcgaccugcccgucuggcuggccuacaagguggccuccgagggguacagcuacgccgaccgccgguggugcuucgagggcgugaagaacaaccagauccucgaggagaaccuggaggucgagaucuggacgaaggagggcgagcgcaagaagcugcggcccaaguggcucgacgcgcgcaccuacuccgacccccaggcccugaaggacuucaaggaguucgccgccgggcgcaagagcaccacccugaaccucaucgcggagcugggccgccugccgacguacaugacccagaagacccgggacgcccucgacaaccuggccgugcugcacaccgccgaggagggcggccgcgccuaccagcacgcgaucuccgagcuccccgagacgcuggagacccugcuccugcugugccuccuggccaccgugagcggcggggucuuccuguuccucauguccggcaaggggaucggcaagaugagcauggggcugggcugcaucaucaccgccuccggccugcucugguacgcccagauccagccccacuggaucgccgcgagcaucauccuggaguucuuccugaucgugcuccugauccccgagccggagaagcagcggacgccccaggacaaccagcugacguacguggucaucgccauccucacccugguggccgccaccauggccaacgagaugggguaccuggagaagaccaagaaggaccucggcuucgggaaccccuacguggcgagccacgaggccgccauccuggacaucgaccugcaccccgccuccgccuggacgcucuacgcggucgccaccacccugaucaccccgaugcugcgccacagcaucgagaacuccagcacgaacgugucccucaccgccaucgccaaccaggcgaccguccugaugggccuggggaagggcuggccccucagccgcauggaccugggcgugccccugcucgcccuggggugcuacucccaggugaacccccugacccucacggccagccugcugcuccugaucggccacuacgccaucaucgggccgggccugcaggccaaggcgacccgggaggcccagaagcgcaccgccgccgggaucaugaagaaccccaccgucgacggcaucacggugaucgacaucgagcccauccccuacgacccgaaguucgagaagcagcucggccaggugaugcugcugguccucugcguggcccaggugcugaugaugcggaccaccugggcgaugugcgaggcccugaccaucgccacggggcccaucuccacccucugggagggcaaccccgggaaguucuggaacaccaccaucgccgucagcauggccaacaucuuccgcggcuccuaccuggcgggcgccgggcugcuguucagcaucaugaagaacacggugaccggccggcgcgggaccggcguggccggggagacccugggcgagaaguggaagaucaagcugaacggccucgggcggacggacuuccagaccuacaagcgcuccggcaucaucgaggucgaccggacccuggccaaggaggggaucaagcgcggcgagaccaaccaccacgcggugagccggggguccgccaagcugcgcugguucguggagcggaaccucgucaagcccgagggcaaggugaucgaccugggcugcgggcgcggcggguggagcuacuacugcggcgggcugaagaacgugacggaggucaagggccucaccaagggcgggccgggccacgaggagcccauccccauguccaccuacggguggaaccuggugcggcugcagagcggcguggacgucuucuucacgcccccggagaagugcgacacgcuccugugcgacaucggggaguccagccccaaccccaccaucgaggccggccgcacccugcgggugcucaacaugguggagaacuggcugggcaacaaccaguucugcaucaagguccugaacccguacaugcccagcgugaucgagaagauggagaaccuccagcgcaaguucgggggcacccuggugcggaacccccugucccgcaacagcacccacgagauguacugggucuccaacgccagcgggaacaucguguccagcgugaacaugaucucccgcaugcugaucaaccgguucacgaugaagcacaagaagcccaccuacgagcaggacgucgaccucggcagcggcacccgcaacguggggaucgagaccgagaagccgaaccuggagaucaucggcaagcggaucgagaagaucaaggacgagcacaagcagacguggcacuacgaccuggaccaccccuacaagaccugggccuaccacggguccuacgagaccaagcagaccggcagcgcguccagcaugaucaacgggguggucaagcuccugacgaagcccugggacgugauccccauggugacccagauggccaugaccgacaccacgccguucggccagcagcgcgucuucaaggagaagguggacacccggacccccgagcccaaggagggcaccaagaagcugaugaagcucacggccaaguggcugugggccgagcuggggcgccacaaggugccccggaugugcacccgcgacgaguucaccaacaagguccgguccaacgccgcgaugggcgccguguucaccgaggagaaccgcuggagcuccgccaaggaggccguggaggacgaggccuucugggaccucgucgaccgggagcgcaagcugcaccuccaggggaagugcgagacgugcguguacaacaugaugggcaagcgggagaagaagcucggggaguucggccgcgcgaagggcagccgggccaucugguacauguggcugggggcccgcuuccuggaguucgaggcccucggcuuccugaacgaggaccacugguucucccgggagaacagccuguccgggguggagggcgaggggcuccacaagcugggcuacauccugcgcgagaucggcgcgaaggacgggggcaugauguacgccgacgacaccgccgggugggacacccgggucaccgaggaggaccucaagaacgaggagaugaucagcgagcagaugaagggcgagcaccgcacgcuggccgaggccaucuucaagcugaccuaccagaacaagguggugcggguccagcgcccgacccccaagggcaccgugauggacaucaucagccgccgggaccagcgcggguccggccagguggggacguacggccucaacaccuucaccaacauggaggcgcagcugauccggcagauggagggggagggccuguuccgcgacaucagcaagcucaccauccaggaggagacggccauccugaccuggcugaaggagaagggccgggaccgccucucccggauggccaucagcggggacgacugcgucgugaagcccgucgacgaccgcuucgcccacgcccugaccgcgcugaacgacaugggcaaggugcggaaggacauccagcagugggaggccuccaagggguggaacgacuggacccaggugcccuucugcagccaccacuuccacgagaucaucaugaaggacggccgcaagcucgucgugccgugccggaaccaggacgagcugaucgggcgcgcccggaucucccagggcgccggcugggcccugaaggagacggcgugccucgggaaggccuacgcccagauguggagccugauguacuuccaccgccgggaccugcgccucgccgccaacgcgaucugcuccgccgugcccagccacuggguccccaccucccggaccaccuggagcauccacgcccaccaccaguggaugaccacggaggacaugcuggacguguggaaccgcguguggauccuggagaaccccuggauggacgacaagaccugcgucaaguccugggaggaggugccguaccucggcaagcgggaggaccaguggugcgggagccugaucggccugaccucccgcgccaccugggcgaagaacaucaagguggccaucgagcagguccgcagccucaucgggaaggaggaguacacggacuacaugcccuccaugaagcgguucaagcaggagcagagcaccgagggcgcccugugguga

SEQ ID NO: 9767 - RNA, 9876 nt, Artificial Sequence
  derived and/or modified CDS sequence (opt1) from DENV-2__GU289914__SS-prME
agcgcggggaugaucaucaugcugauccccaccgugauggccuuccaccucaccacccgcaacggggagccccacaugaucgugucccggcaggagaagggcaagagccugcuguucaagaccgaggacggggugaacaugugcacccucauggcgauggaccugggcgagcugugcgaggacaccaucaccuacaacugcccccuccugcgccagaacgagcccgaggacaucgacugcuggugcaacuccaccagcaccugggugaccuacgggaccugcaccaccaccggcgagcaccggcgcgagaagcgguccgucgcccuggugccccacgugggcauggggcucgagacgcgcaccgagaccuggaugagcuccgagggcgccuggaagcacgcccagcggaucgagaccuggauccugcgccacccgggguucacgaucauggccgcgauccuggccuacaccaucggcaccacccacuuccagcgggcccucaucuucauccugcugacggccgucgcgcccagcaugaccaugcgcugcaucgggaucuccaaccgggacuucguggagggcgugagcggcggguccugggucgacaucgugcucgagcacggcagcugcgugaccaccauggccaagaacaagcccacgcuggacuucgagcugaucaagaccgaggccaagcagcccgccacccuccgcaaguacugcaucgaggccaagcugaccaacacgaccaccgagucccggugccccacccagggggagcccagccugaacgaggagcaggacaagcgcuucgucugcaagcacuccaugguggaccggggcuggggcaacgggugcggccucuucgggaagggcgggaucgugacgugcgcgauguucacgugcaagaagaacauggagggcaaggucgugcagcccgagaaccuggaguacaccaucguggucacgccccacagcggcgaggagcacgccguggggaacgacacgggcaagcacgggaaggagaucaaggugaccccgcaguccagcaucaccgaggccgagcugaccggcuacgggaccgucacgauggagugcagcccccgcaccggccucgacuucaacgagauggugcugcugcagauggagaacaaggccuggcucgugcaccggcagugguuccuggaccugccccuccccuggcugccgggcgccgacacccaggggagcaacuggauccagaaggagacccuggucacguucaagaacccccacgcgaagaagcaggacguggucgugcucggcagccaggagggggccaugcacaccgcccugaccggcgccaccgagauccagauguccagcgggaaccuccuguucacgggccaccugaagugccgccugcggauggacaagcuccagcugaagggcauguccuacagcaugugcaccgggaaguucaagguggucaaggagaucgccgagacccagcacggcaccaucgugauccgcgugcaguacgagggggacggcucccccugcaagauccccuucgagaucauggaccuggagaagcggcacguccucggccgccugaucacggugaacccgaucgugaccgagaaggacagccccgucaacaucgaggcggagccgcccuucggggacuccuacaucaucaucggcguggacccggggcagcugaagcucaacugguucaagaagggcagcuccaucgggcagauguucgagaccaccaugcgcggcgccaagcggauggccauccugggcgacacggccugggacuucgggagccugggcgggguguucaccuccaucggcaaggcccuccaccaggucuucggggcgaucuacggcgccgccuucagcggcguguccuggaccaugaagauccugaucggggugaucaucaccuggaucggcaugaacagccgcuccacgagccuguccgucagccuggugcucguggggaucgucacccuguaccugggcgugauggugcaggccgacuccgggugcgucgugagcuggaagaacaaggagcucaagugcggcagcggcaucuucaucaccgacaacgugcacaccuggacggagcaguacaaguuccagcccgagucccccagcaagcuggcguccgccauccagaaggcccaggaggaggggaucugcggcauccggagcgucacccgccuggagaaccucauguggaagcagaucacccccgagcugaaccacauccuggccgagaacgaggugaagcucaccaucaugacgggggacaucaagggcaucaugcaggccgggaagcggucccugcgcccgcagcccaccgagcugaaguacagcuggaagaccuggggcaaggcgaagaugcucuccaccgagagccacaaccagacguuccugaucgacggccccgagaccgccgagugcccgaacaccaaccgggccuggaacucccuggagguggaggacuacggguucggcgucuucaccacgaacaucuggcucaagcugaaggagaagcaggacgccuucugcgacagcaagcugauguccgccgcgaucaaggacaaccgcgccgugcacgccgacaugggguacuggaucgagagcgcccucaacgacaccuggaagaucgagaaggccuccuucaucgaggugaagaacugccacuggcccaagagccacacccugugguccaacggcguccuggagagcgagaugaucauccccaagaaccucgcgggccccgugucccagcacaacuaccggccgggguaccacacccagaucgccggccccuggcaccuggggaagcuggagauggacuucgacuucugcgacggcaccacgguggucgugaccgaggacugcgggaaccgcggccccagccuccggaccaccacggccagcggcaagcugaucaccgaguggugcugccgcuccugcacccugcccccgcuccgguaccgcggggaggacggcugcugguacgggauggagauccggccccugaaggagaaggaggagaaccuggugaacagccucgucaccgccggccacggccagguggacaacuucucccugggcgugcugggcauggcccuguuccuggaggagaugcugcgcacgcgggucgggaccaagcacgccauccuccugguggccgugagcuucgucacccugaucaccggcaacauguccuuccgcgaccucgggcgggugguggucauggugggcgccacgaugaccgacgacaucgggaugggcgugaccuaccuggcccugcucgcggccuucaagguccgccccaccuucgccgccggccugcugcuccgcaagcugacgagcaaggagcugaugaugaccaccaucgggaucgugcuccugucccagagcaccauccccgagacgauccuggagcucaccgacgcccuggcgcugggcaugauggugcucaagaugguccggaacauggagaaguaccagcuggccgugaccaucauggccauccugugcgucccgaacgccgugauccuccagaacgccuggaagguguccugcaccauccuggcggucgugagcgugagcccccugcuccugacgagcucccagcagaagaccgacuggaucccccuggcccucaccaucaaggggcugaaccccaccgccaucuuccugacgacccucagccgcaccuccaagaagcggagcuggccgcugaacgaggccaucauggcggucggcaugguguccauccuggccagcucccuccugaagaacgacauccccaugaccggcccccugguggccgggggccuccugacggucugcuacgugcugaccgggcgcagcgccgaccucgagcuggagcgggccgcggacgugaagugggaggaccaggccgagaucagcggcuccagccccauccuguccaucaccaucagcgaggacggguccaugagcaucaagaacgaggaggaggagcagacccucacgauccugauccgcaccggccugcucgucaucuccggccuguucccggugagcauccccaucaccgccgccgccugguaccugugggaggugaagaagcagcgggcggggguccucugggacgugcccagcccgccgcccaugggcaaggccgagcuggaggacggggccuaccgcaucaagcagaagggcauccugggguacagccagaucggcgccggcguguacaaggaggggaccuuccacaccauguggcacgucacgcggggcgccgugcucaugcacaaggggaagcgcaucgagcccuccugggcggacgugaagaaggaccugaucagcuacggcgggggcuggaagcuggagggcgaguggaaggagggggaggagguccaggugcucgcccuggagcccggcaagaacccccgggccgugcagaccaagcccgggcuguuccgcaccaacgccggcaccaucggggccgucucccucgacuucagccccggcacguccggcagccccaucaucgacaagaaggggaagguggugggccuguacgggaacggcgucgugacccgguccggcgcguacgugagcgccaucgcccagaccgagaaguccaucgaggacaaccccgagaucgaggacgacaucuuccgcaagcggcgccugaccaucauggaccugcaccccggggccggcaagacgaagcgguaccuccccgcgaucguccgcgaggccaucaagcgggggcugcgcacccugauccucgccccgacccgggugguggccgccgagauggaggaggcgcugcgcggccugcccauccgcuaccagacccccgccauccgggccgagcacacggggcgcgagaucgucgaccucaugugccacgccaccuucaccaugcggcugcugagccccgugcgcgugccgaacuacaaccucaucaucauggacgaggcccacuucaccgaccccgcgagcaucgccgcccggggcuacaucuccacgcgcgucgagaugggcgaggccgccgggaucuucaugaccgcgacgccgcccggcagccgggacccguucccccaguccaacgcccccaucaucgacgaggagcgcgagauccccgagcggagcuggaacuccgggcacgagugggugaccgacuucaagggcaagacggugugguucgucccgagcaucaaggccgggaacgacaucgccgcgugccugcgcaagaacggcaagaaggugauccagcugucccggaagaccuucgacagcgaguacgugaagacccgcaccaacgacugggacuucgucgugacgaccgacaucuccgagaugggcgccaacuucaaggccgagcgggugaucgacccccgccggugcaugaagcccgucauccucaccgacggggaggagcgcgugauccuggccggccccaugccggugacccacagcuccgccgcgcagcggcgcgggcggaucggccgcaaccccaagaacgagaacgaccaguacaucuacaugggggagccccuggagaacgacgaggacugcgcccacuggaaggaggccaagaugcuccuggacaacaucaacacgcccgagggcaucaucccgagcauguucgagcccgagcgcgagaaggucgacgccaucgacggcgaguaccggcugcgcggggaggcccggaagaccuucguggaccucaugcgccggggcgaccugcccguguggcuggcguacaaggucgccgccgaggggaucaacuacgccgaccgccgguggugcuucgacggcaucaagaacaaccagauccucgaggagaacguggaggucgagaucuggaccaaggagggggagcgcaagaagcugaagccgcgguggcuggacgcccgcaucuacuccgacccccucgcgcugaaggaguucaaggaguucgccgccggccggaagucccugacccucaaccugaucacggagaugggccgccugcccaccuucaugacccagaaggcccgggacgcgcucgacaaccuggccgugcugcacaccgccgaggccgggggccgcgccuacaaccacgcgcucuccgagcugcccgagacgcuggagacccuccugcugcucacccugcuggccaccgugaccggcgggaucuuccucuuccugaugagcgggcgggggaucggcaagaugacccuggggaugugcugcaucaucaccgccuccauccuccugugguacgcccagauccagccgcacuggaucgccgcgagcaucauccuggaguucuuccucaucguccugcugauccccgagcccgagaagcagcgcacgccccaggacaaccagcucaccuacguggugaucgccauccugacggucguggccgccaccauggccaacgagaugggcuuccuggagaagaccaagaaggaccucgggcugggcuccaucgcgacccagcagccggagagcaacauccuggacaucgaccuccggcccgccagcgccuggacgcuguacgccguggccaccaccuucgucacccccaugcugcgccacuccaucgagaacagcuccgugaacgugagccucacggcgaucgccaaccaggccaccguccugaugggccuggggaagggcuggccccucuccaagauggacaucggggugccgcugcuggccaucggcugcuacagccaggugaaccccaucacccucaccgcggcccugcugcuccuggucgcccacuacgccaucaucgggcccggccugcaggccaaggcgacgcgggaggcccagaagcgcgccgccgccggcaucaugaagaaccccaccguggacgggaucaccgugaucgaccucgacccgauccccuacgaccccaaguucgagaagcagcugggccaggucaugcugcucgugcugugcgugacccagguccugaugaugcggacgaccugggcgcucugcgaggcccugacccuggccaccgggcccaucuccacgcucugggagggcaacccggggcgcuucuggaacaccaccaucgccgugagcauggccaacaucuuccgcggcuccuaccuggcgggcgccgggcuccucuucagcaucaugaagaacaccacgaacacccggcgcggcaccgggaacaucggcgagacccugggcgagaaguggaagucccggcugaacgcccucgggaaguccgaguuccagaucuacaagaaguccggcauccaggagguggaccgcacgcuggccaaggaggggaucaagcggggcgagaccgaccaccacgcggucagccgcggguccgccaagcugcggugguucguggagcgcaacauggugacccccgagggcaaggucguggaccucggcugcgggcggggcggguggagcuacuacugcggcgggcugaagaacgugcgcgaggucaagggccugaccaagggcgggcccggccacgaggagcccaucccgauguccacguacggguggaaccucgugcggcugcagagcggcguggacgucuucuucaucccgcccgagaagugcgacacccugcucugcgacaucggggaguccagccccaacccgaccguggaggccggccgcacccugcgggugcugaaccucgucgagaacuggcugaacaacaacacgcaguucugcaucaaggugcugaaccccuacaugcccagcgugaucgagaagauggagacccugcagcgcaaguacggcggggcccucguccggaacccgcugucccgcaacagcacccacgagauguacuggguguccaacgccagcggcaacaucguguccagcgucaacaugaucucccggaugcugaucaaccgcuucaccaugcggcacaagaaggcgaccuacgagcccgacguggaccucgggagcggcacgcgcaacaucgggaucgaguccgagauccccaaccuggacaucaucggcaagcgcaucgagaagaucaagcaggagcacgagaccagcuggcacuacgaccaggaccaccccuacaagaccugggccuaccacggcuccuacgagaccaagcagacggggagcgccuccagcauggugaacggcgucgugcggcugcucaccaagccgugggacgugguccccauggugacccagauggccaugaccgacacgacccccuucgggcagcagcgcguguucaaggagaaggucgacacccggacccaggagcccaaggagggcacgaagaagcugaugaagaucaccgccgaguggcuguggaaggagcucggcaagaagaagaccccgcgcaugugcacccgggaggaguucacgcgcaaggugcgguccaacgcggcccugggggccaucuucaccgacgagaacaaguggaaguccgcccgcgaggccgucgaggacucccgguucugggagcugguggacaaggagcgcaaccuccaccuggagggcaagugcgagaccugcguguacaacaugauggggaagcgggagaagaagcugggcgaguucgggaaggcgaagggcagccgcgccaucugguacauguggcucggcgcccgguuccuggaguucgaggcccugggguuccucaacgaggaccacugguucucccgcgagaacagccugagcggcgucgagggggagggccugcacaagcucggguacauccugcgggacguguccaagaaggagggcggcgcgauguacgccgacgacaccgccgggugggacacgcgcaucacccuggaggaccucaagaacgaggagauggugaccaaccacauggagggcgagcacaagaagcuggccgaggccaucuucaagcugaccuaccagaacaaggucgugcgggugcagcgccccacgccccgggggaccgucauggacaucaucagccgccgggaccagcgcggcuccggccaggugggcaccuacggccucaacaccuucacgaacauggaggcgcagcugauccgccagauggagggggagggcguguucaagaacauccagcaccugaccgucaccgaggagaucgccgugcagaacuggcucgcccggguggggcgcgagcggcugagccgcauggccaucuccggcgacgacugcgucgugaagccccuggacgaccgguucgccagcgcgcucaccgcccugaacgacaugggcaagauccgcaaggacauccagcagugggagccgucccggggguggaacgacuggacgcagguccccuucugcagccaccacuuccacgagcugaucaugaaggacggccgcguccucguggugcccugccggaaccaggacgagcugaucgggcgcgcccggaucucccagggcgccggguggagccugcgcgagaccgccugccucggcaaguccuacgcgcagauguggagccugauguacuuccaccggcgcgaccugcggcucgccgccaacgccaucugcuccgccguccccagccacugggugccgaccucccgcaccacguggagcauccacgcgaagcacgaguggaugaccaccgaggacaugcugaccguguggaaccgggucuggauccaggagaaccccuggauggaggacaagacccccguggaguccugggaggagauccccuaccugggcaagcgcgaggaccaguggugcgggagccucaucggccugacgagccgggccaccugggccaagaacauccaggccgcgaucaaccaggugcgcucccugaucgggaacgaggaguacaccgacuacaugccgagcaugaagcgcuuccggcgcgaggaggaggaggccggcguccucugguga

SEQ ID NO: 9768 - RNA, 9876 nt, Artificial Sequence
  derived and/or modified CDS sequence (opt1) from DENV-2__AY858036__SS-prME
accgccggcaucaucaucaugaugauccccaccgugauggccuuccaccugaccacccggaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcuggugcaacagcaccuccaccugggugaccuacgggaccugcaccgccaccggcgagcaccggcgcgagaagcggagcgucgcccuggugccccacgugggcauggggcuggagacccgcaccgagaccuggauguccagcgagggcgccuggaagcacgcccagcggaucgagaccuggguccuccgccaccccggguucaccaucauggcggccauccuggccuacaccaucggcaccaccuacuuccagcgggugcugaucuucauccuccugaccgccguggcgcccuccaugaccaugcgcugcaucgggaucagcaaccgggacuucgucgagggcguguccggcgggagcuggguggacaucguccuggagcacggcuccugcgugaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcauggucgaccggggcuggggcaacgggugcggccuguucgggaagggcgggaucgugacgugcgccauguucacgugcaagaagaacauggagggcaagaucgugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggagaacaaggccuggcuggugcaccggcagugguuccucgaccugccccugcccuggcucccgggcgcggacacccagggguccaacuggauccagaaggagacccuggucacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucgugaccgacaacgugcacaccuggacggagcaguacaaguuccagcccgagucccccagcaagcucgccuccgccauccagaaggcccacgaggaggggaucugcggcauccggagcgucacccgccuggagaaccugauguggaagcagaucacccccgagcucaaccacauccuguccgagaacgaggugaagcugaccaucaugacgggggacaucaagggcaucaugcaggccgggaagcggagccuccgcccgcagcccaccgagcugaaguacuccuggaagaccuggggcaaggcgaagaugcugagcaccgagcuccacaaccacacguuccugaucgacggccccgagaccgccgagugcccgaacaccaaccgggccuggaacucccuggagguggaggacuacggguucggcgucuucaccacgaacaucuggcucaagcugaaggagcgccaggacguguucugcgacagcaagcugauguccgccgccaucaaggacaaccgggcggugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgccggccccgugagccagcacaacuaccgcccgggguaccacacccagaccgcgggccccuggcaccucgggcggcuggagauggacuucgacuucugcgagggcacgaccgucguggugaccgaggacugcgggaaccgcggccccagccugcggaccacgaccgccuccggcaagcucaucaccgaguggugcugccgcagcugcacccugcccccgcugcgguaccgcggggaggacggcugcugguacgggauggagauccggccccucaaggagaaggaggagaaccuggucaacucccuggugacggccggccacgggcagaucgacaacuucagccucggcgugcugggcauggcccuguuccucgaggagaugcugcgcacccgggucgggaccaagcacgcgauccugcucguggccguguccuucgucacccugaucacgggcaacaugagcuuccgcgaccuggggcgcgugauggugauggucggcgccaccaugaccgacgacaucgggaugggcgugaccuaccucgcccugcuggccgcguucaaggugcggcccacguucgccgccggccuccugcugcgcaagcucaccuccaaggagcugaugaugaccaccaucgggaucguccugcucagccaguccacgauccccgagaccauccuggagcugaccgacgcccucgcccugggcaugauggugcugaagaucguccggaacauggagaaguaccagcucgcggugaccaucauggccauccugugcgugccgaacgccgucauccugcagaacgccuggaaggugagcugcacgacccucgccguggucuccgugagcccccugcugcucaccuccagccagcagaaggcggacuggaucccccuggcccugaccaucaaggggcucaaccccacggccaucuuccugaccacccuggcccgcaccuccaagaagcggagcuggccgcucaacgaggcgaucauggccgugggcauggucuccauccuggccagcucccugcucaagaacgacauccccaugacgggcccccugguggccgggggccugcucaccgugugcuacguccugaccgggcgcagcgccgaccuggagcucgagcgggcggccgacgugcgcugggaggagcaggccgagaucagcggcuccagccccauccuguccaucaccaucagcgaggacggguccaugagcaucaagaacgaggaggaggagcagacgcugaccauccucauccggaccggccugcuggugaucuccggccucuucccggucagcauccccaucaccgccgccgcgugguaccugugggaggugaagaagcagcgcgccggggugcugugggacguccccagcccgccgcccgugggcaaggccgagcucgaggacggggccuaccggaucaagcagaagggcauccugggguacagccagaucggcgccggcguguacaaggaggggaccuuccacacgauguggcacgucacccgcggcgcggugcugaugcacaaggggaagcggaucgagcccuccugggccgacgugaagaaggaccucaucagcuacggcgggggcuggaagcuggagggcgaguggaaggagggggaggagguccaggugcuggcccucgagcccggcaagaacccccgcgccgugcagaccaagcccgggcuguucaagaccaacacgggcaccaucggggccgucucccuggacuucagccccggcaccuccggcagccccaucguggacaagaaggggaagguggucggccucuacgggaacggcguggugacccgguccggcacguacgucagcgcgaucgcccagaccgagaaguccaucgaggacaaccccgagaucgaggacgacaucuuccgcaagaagcggcugaccaucauggaccugcaccccggggccggcaagaccaagcgcuaccugcccgccaucgugcgggaggcgaucaagcgcgggcuccggacgcugauccuggccccgacccgcguggucgccgccgagauggaggaggcccuccgcggccugcccauccgguaccagacccccgcgauccgcgccgagcacaccgggcgggagaucguggaccugaugugccacgccacguucaccaugcgccuccugagccccauccgggugccgaacuacaaccugaucaucauggacgaggcccacuucaccgaccccgccagcaucgcggcccgcggcuacaucuccacccgggucgagaugggcgaggccgccgggaucuucaugacggccacgccgcccggcagccgcgacccguucccccaguccaacgcgcccaucauggacgaggagcgggagauccccgagcgcagcuggaacuccgggcacgagugggugaccgacuucaagggcaagaccgugugguucgucccgagcaucaaggccgggaacgacaucgccgccugccuccggaagaacggcaagaaggugauccagcugucccgcaagacguucgacagcgaguacaucaagacccggaccaacgacugggacuucguggucaccacggacaucuccgagaugggcgcgaacuucaaggccgagcgcgugaucgacccccggcgcugcaugaagcccgugauccugaccgacggggaggagcgggucauccucgccggccccaugccggugacccacagcuccgccgcccagcgccgggggcgcgugggccgcaaccccaagaacgagaacgaccaguacaucuacaugggggagccccuggagaacgacgaggacugcgcgcacuggaaggaggccaagaugcugcucgacaacaucaacacccccgagggcaucaucccgagcauguucgagcccgagcgggagaaggucgacgccaucgacggcgaguaccgccugcgcggggaggcccgcaagacguucguggaccugaugcggcgcggcgaccuccccgucuggcuggccuaccggguggcggccgaggggaucaacuacgccgaccgccgguggugcuucgacggcgugaagaacaaccagauccuggaggagaacgucgagguggagaucuggaccaaggagggggagcgcaagaagcucaagccgcgguggcuggacgcccgcaucuacuccgacccccuggcccucaaggaguucaaggaguucgcggccggccggaagucccugacccugaaccucaucaccgagaugggccgccugcccacguucaugacccagaaggcccggaacgcccuggacaaccucgcggugcugcacaccgccgagaccgggggccgcgccuacaaccacgcccuguccgagcuccccgagacgcuggagacccugcuccugcugacccuccuggccaccgucaccgggggcaucuuccuguuccucaugagcggcaaggggaucggcaagaugacgcuggggaugugcugcaucaucaccgcguccauccugcucugguacgcccagauccagccgcacuggaucgccgccagcaucauccuggaguucuuccugaucgugcuccugauccccgagcccgagaagcagcggacgccccaggacaaccagcugaccuacguggucaucgccauccucacggugguggcggccaccauggccaacgagaugggcuuccuggagaagaccaagaaggacuucgggcugggcuccaucaccacgcagcagccggagagcaacauccucgacaucgaccugcgccccgccagcgccuggacccuguacgcggucgccaccaccuucaucacgcccaugcuccggcacuccaucgagaacagcuccgugaacgugagccugaccgccaucgccaaccaggccaccguccugaugggccucgggaagggcuggccccuguccaagauggacaucggggugccgcugcucgcgaucggcugcuacagccaggugaaccccaucacccugacggccgcccugcuccugcuggucgcccacuacgcgaucaucgggcccggccuccaggccaaggccacccgcgaggcccagaagcgggccgcggccggcaucaugaagaaccccaccguggacgggaucaccgugaucgaccuggacccgauccccuacgaccccaaguucgagaagcagcugggccaggucaugcuccuggugcugugcgugacgcagguccucaugaugcgcaccaccugggcccugugcgaggcccugacccucgccacggggcccaucuccacccugugggagggcaacccggggcgcuucuggaacaccaccaucgcggugagcauggccaacaucuuccggggcuccuaccuggccggcgccgggcuccuguucagcaucaugaagaacacggccaacacccgccggggcaccgggaacaccggcgagacgcugggcgagaaguggaagaaccgccucaacgcgcuggggaaguccgaguuccagaucuacaagaaguccggcauccaggagguggaccggacccuggccaaggaggggaucaagcgcggcgagaccgaccaccacgccgucucccgggggagcgccaagcuccgcugguucguggagcggaaccuggugacccccgagggcaaggucguggaccugggcugcgggcgcggcgggugguccuacuacugcggcgggcucaagaacgugaaggaggucaagggccugacgaagggcgggcccggccacgaggagcccaucccgaugagcaccuacggguggaaccuggugcggcuccaguccggcguggacgucuucuucacgccgcccgagaagugcgacacccugcugugcgacaucggggagagcucccccaacccgaccguggaggcgggccgcacgcuccgggugcugaaccuggucgagaacuggcucaacaacaacacccaguucugcaucaaggugcugaaccccuacaugcccagcgugaucgagaagauggaggcccugcagcgcaaguacggcggggcccugguccggaacccgcucagccgcaacuccacccacgagauguacugggugagcaacgccuccggcaacaucgugagcuccgucaacaugaucagccggaugcugaucaaccgcuucaccaugcggcacaagaaggccacguacgagcccgacguggaccugggguccggcacccgcaacaucgggaucgagagcgagacccccaaccucgacaucaucggcaagcgcaucgagaagaucaagcaggagcacgagaccuccuggcacuacgaccaggaccaccccuacaagacgugggcguaccacggcagcuacgagaccaagcagaccggguccgccagcuccauggugaacggcgucgugcggcugcugaccaagccgugggacgugauccccauggucacgcagauggccaugaccgacaccacccccuucgggcagcagcgcguguucaaggagaaggucgacacgcggacccaggagcccaaggagggcaccaagaagcucaugaagaucaccgccgaguggcuguggaaggagcugggcaagaagaagacgccgcgcaugugcacccgggaggaguucacccgcaaggugcggagcaacgccgcgcucggggccaucuucaccgacgagaacaaguggaaguccgcccgcgaggccguggaggacagcgaguucugggagcuggucgacaaggagcggaaccugcaccucgagggcaagugcgagacgugcguguacaacaugauggggaagcgcgagaagaagcugggcgaguucgggaaggccaagggcucccgggcgaucugguacauguggcugggcgcccgcuuccucgaguucgaggcccugggguuccugaacgaggaccacugguucagccgggagaacucccucagcggcguggagggggagggccugcacaagcugggguacauccuccgcgacgucagcaagaaggagggcggcgccauguacgcggacgacaccgccgggugggacacccggaucacccuggaggaccugaagaacgaggagauggugacgaaccacauggagggcgagcacaagaagcucgccgaggccaucuuccgccugaccuaccagaacaaggugguccgggugcagcgccccacgccccgggggaccgugauggacaucaucucccgccgggaccagcgcggcagcgggcaggucgugacguacggccugaacaccuucaccaacauggaggcccagcucauccgccagauggagggcgaggggguguucaaguccauccagcaccugaccgucacggaggagaucgcggugaagaacuggcuggugcgggucggccgcgagcggcucagccgcauggccaucuccggggacgacugcguggugaagccccuggacgaccgguucgccagcgcccugaccgcccucaacgacaugggcaagguccgcaaggacauccagcagugggagccgucccggggcuggaacgacuggacccaggugcccuucugcagccaccacuuccacgagcugaucaugaaggacgggcgcgugcuggucgugcccugccggaaccaggacgagcucaucggccgcgcgcggaucucccagggggccggcuggagccugcgcgagaccgccugccuggggaaguccuacgcccagauguggagccucauguacuuccaccggcgcgaccugcggcuggccgcgaacgccaucugcuccgccgugcccagccacugggucccgaccucccgcacgaccuggagcauccacgccacccacgaguggaugaccacggaggacaugcucaccguguggaaccggguguggauccaggagaaccccuggauggaggacaagacccccgucgaguccugggaggagauccccuaccugggcaagcgcgaggaccaguggugcggcagccugaucgggcucaccagccgggccacgugggcgaagaacauccagaccgccaucaaccaggugcgcucccugaucggcaacgaggaguacaccgacuacaugccgagcaugaagcgcuuccggcgcgaggaggaggaggccggggugcugugguga

SEQ ID NO: 9769 - RNA, 9876 nt, Artificial Sequence
  derived and/or modified CDS sequence (opt1) from DENV-2__HQ332184__SS-prME
accgcgggcgugaucaucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcggccuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccucuucaccggccaccugaagugccgccugcggauggacaagcuccagcugaaggggauguccuacagcaugugcaccggcaaguucaagaucgucaaggagaucgccgagacccagcacgggacgaucgugauccgcauccaguacgagggcgacggcucccccugcaagauccccuucgagaucaccgaccuggagaagcggcacgugcucgggcgccugaucaccgucaacccgaucgugaucgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccggcugggacuucgggagccugggcgggguguucaccuccaucggcaaggcccuccaccagguguucggcgccaucuacggggcggccuucagcggcgucuccuggaccaugaagauccugaucgggguggugaucacguggaucggcaugaacagccgcuccaccagccuguccgucagccuggugcucgugggggucgugacccuguaccugggcgccauggugcaggccgacuccggcugcgucgugagcuggaagaacaaggagcucaagugcggguccggcaucuucaucaccgacaacgugcacacguggaccgagcaguacaaguuccagcccgagagccccagcaagcuggcguccgccauccagaaggcccacgaggaggggaucugcggcauccggagcgucacccgccuggagaaccucauguggaagcagaucacccccgagcugaaccacauccuguccgagaacgaggugaagcucacgaucaugaccggggacaccaagggcaucaugcaggccggcaagcggagccugcgcccgcagcccaccgagcugaaguacuccuggaagacgugggggaaggccaagaugcucagcaccgagucccacaaccagaccuuccugaucgacggccccgagaccgcggagugcccgaacacgaaccgggccuggaacagccuggagguggaggacuacggguucggcgucuucaccaccaacaucuggcucaagcugcgcgagaagcaggacguguucugcgacuccaagcugaugagcgccgccaucaaggacaaccgggccgugcacgcggacaugggcuacuggaucgaguccgcccucaacgacaccuggaagauggagaaggccagcuucaucgaggucaaguccugccacuggcccaagagccacacccugugguccaacggggugcuggagagcgagaugaucauccccaagaacuucgccggccccgugucccagcacaacuaccgcccgggguaccacacgcagaccgccggccccuggcaccucgggaagcuggagauggacuucgacuucugcgagggcaccaccgucguggugacggaggacugcggcaaccgggggcccagccugcgcaccaccaccgcgagcggcaagcucaucacggaguggugcugccgguccugcacccugcccccgcugcgcuaccgcggggaggacggcugcugguacgggauggagauccgcccccucaaggagaaggaggagaaccuggucaacagccuggugaccgccggccacggccagaucgacaacuucucccucggggugcugggcauggcccuguuccucgaggagaugcugcggacccgcgucgggacgaagcacgccacccugcucguggcggccagcuucgugacccugaucaccggcaacauguccuuccgggaccuggggcgcgucauggugauggugggcgccacgaugaccgacgacaucggcaugggggucaccuaccucgcccugcuggccgcguucaaggugcgccccaccuucgccgccggccuccugcugcggaagcucacgagcaaggagcugaugauggccaccaucgggaucacccugcucucccagagcaccauccccgagacgauccuggagcugaccgacgcccucgcgcugggcaugauggugcugaagaucguccgcaacauggagaaguaccagcucgccgugaccaucauggccaucuccugcgugccgaacgccgucauccugcggaacgccuggaaggugagcugcaccauccuggcggccguguccgucagcccccuccugcugacguccagccagcagaaggccgacuggaucccccucgcccugaccaucaagggccugaaccccaccgcgaucuuccucaccacgcugucccgcaccagcaagaagcgguccuggccgcugaacgaggccaucauggccguggggauggucagcauccucgccuccagccugcugaagaacgacauccccaugaccggcccccucguggccgggggccugcugaccgugugcuacguccucacggggcgcagcgcggaccuggagcuggagcgggccgccgacgugaagugggaggaccaggccgagaucuccggcagcucccccauccucagcaucaccaucuccgaggacggcagcauguccaucaagaacgaggaggaggagcagacccugaccauccugauccgcaccgggcuccuggugaucagcggcgucuucccgguguccauccccaucacggccgcggccugguaccugugggaggugaagaagcagcgggccgggguccucugggacgugcccagcccgccgcccgugggcaaggccgagcuggaggacggggccuaccgcaucaagcagcggggcauccugggcuacucccagaucggggcgggcgucuacaaggaggggaccuuccacaccauguggcacgugacccgcggcgccgugcucaugcaccgggggaagcgcaucgagcccagcugggccgacgucaagaaggaccugaucuccuacggcggcggguggaagcuggagggcgaguggaaggagggggaggagguccaggugcucgcccuggagcccggcaagaacccccgggccguccagacgaagcccgggaucuucaagaccaacaccggcaccaucggcgcggugagccuggacuucucccccgggacgagcggcucccccaucguggaccgcaaggggaaggucgugggccucuacggcaacgggguggucacccggagcggcgccuacguguccgccaucgcccagaccgagaaguccaucgaggacaaccccgagaucgaggacgacaucuuccgcaagaagcggcugaccaucauggaccugcaccccggggcgggcaagacgaagcgcuaccuccccgccaucgugcgggaggccaucaagcgcgggcugcgcacccugauccuggccccgacccgggucguggccgcggagauggaggaggcccuccgcggccugcccauccgguaccagacccccgccaucaaggccgagcacacgggccgcgagaucguggaccugaugugccacgccaccuucaccaugcggcuccugagccccguccgcgugccgaacuacaaccugaucaucauggacgaggcgcacuucaccgaccccgccuccaucgccgcccggggguacaucagcacgcgcguggagaugggcgaggccgcggggaucuucaugaccgccacgccgcccggcucccgggacccguucccccagagcaacgcccccaucauggacgaggagcgcgagauccccgagcgguccuggaacagcgggcacgagugggucaccgacuucaagggcaagacggugugguucgugccguccaucaaggccggcaacgacaucgcggccugccuccgcaagaacgggaagaaggucauccagcugagccggaagaccuucgacuccgaguacgugaagacccgcgccaacgacugggacuucguggucaccacggacaucagcgagaugggcgccaacuucaaggccgagcgggugaucgacccccgccggugcaugaagcccgugauccugaccgacggggaggagcgcgucauccucgcgggccccaugccggugacccacuccagcgccgcccagcggcgcgggcgcaucggccggaaccccaagaacgagaacgaccaguacaucuacaugggcgagccccuggagaacgacgaggacugcgcccacuggaaggaggccaagaugcugcucgacaacaucaacacccccgaggggaucaucccguccauguucgagcccgagcgcgagaagguggacgcgaucgacggcgaguaccggcugcgcggggaggcccggaagacguucgucgaccugaugcgccggggcgaccuccccguguggcuggccuacaagguggccgccgaggggaucaacuacgcggaccgcaaguggugcuucgacggcaucaagaacaaccagauccuggaggagaacgucgagguggagaucuggaccaaggagggcgagcggaagaagcucaagccgcgcuggcuggacgcccggaucuacagcgacccccuggcccucaaggaguucaaggaguucgccgcggggcgcaagucccugacccugaaccucaucaccgagaugggccggcugcccacguucaugacccagaaggcccgcaacgcccuggacaaccucgccgugcugcacaccgccgaggccggcgggcgggccuacaaccacgcccugagcgagcuccccgagacccuggagacgcugcuccugcugacccuccuggccaccgucaccggcgggaucuuccuguuccucauguccgggaaggggaucggcaagaugacccuggggaugugcugcaucaucacggccagcgugcugcucugguacgcgcagauccagccgcacuggaucgccgccuccaucauccuggaguucuuccugaucguccuccugauccccgagcccgagaagcagcgcacgccccaggacaaccagcugaccuacguggugaucgccauccucaccgucguggccgcgacgauggccaacgagaugggcuuccuggagaagaccaagaaggaccugggccucgggagcaucaccacccaggagagcgaguccaacauccuggacaucgaccugcggccggccagcgccuggacgcucuacgccguggcgaccaccuucgucacccccaugcugcgccacuccaucgagaacagcuccgugaacgugagccugacggccaucgccaaccaggccaccguccucaugggccuggggaagggcuggccccuguccaagauggacaucggggugccccuccuggcgaucggcugcuacagccaggugaacccgaucacccugaccgccgcccuccugcugcucgucgcccacuacgccaucaucggccccgggcugcaggcgaaggccacgcgggaggcccagaagcgcgccgccgcgggcaucaugaagaaccccaccguggacgggaucaccgugaucgaccuggagcccaucccguacgaccccaaguucgagaagcagcucggccaggucaugcugcugauccucugcgugacccaggugcugaugaugcggacgaccugggcccugugcgaggcccucacccuggccaccgggcccaucuccacgcugugggagggcaaccccggccgcuucuggaacaccaccaucgccgucagcauggcgaacaucuuccgcggguccuaccucgccggcgccgggcugcuguucagcaucaugaagaacaccacgaacacccggcgcggcaccggcaacaucggggagacccucggcgagaaguggaagucccggcugaacgcccugggcaagagcgaguuccagaucuacaagaaguccggcauccaggagguggaccgcacgcucgcgaaggaggggaucaagcggggcgagaccgaccaccacgccgugagccgcggcuccgccaagcugcggugguucgucgagcgcaacauggugaccccggaggggaagguggucgaccugggcugcgggcggggcggguggagcuacuacugcggcggccucaagaacgugcgcgaggugaaggggcugaccaagggcgggcccggccacgaggagcccauccccauguccacguacggguggaaccugguccggcuccagagcggcguggacguguucuucaccccgcccgagaagugcgacacccugcugugcgacaucggcgagagcucccccaaccccaccaucgaggccgggcgcacccuccggguccugaaccugguggagaacuggcucaacaacaacacgcaguucugcaucaaggugcugaacccguacaugcccagcgucaucgagaagauggagacccugcagcgcaaguacggcggggcccucgugcggaacccccugucccgcaacagcacccacgagauguacuggguguccaacgcgaccggcaacaucgucagcuccgugaacaugaucagccggaugcugaucaaccgcuucacgaugaagcacaagaaggccaccuacgagccggacguggaccugggguccggcacccggaacaucggcaucgagagcgagauccccaaccucgacaucaucgggaagcgcaucgagaagaucaagcaggagcacgagaccuccuggcacuacgaccaggaccaccccuacaagacgugggccuaccacggcagcuacgagaccaagcagaccggguccgccagcuccauggucaacggcguggugcgccugcugaccaagcccugggacgucgugccgauggugacgcagauggccaugaccgacaccacccccuucggccagcagcgggucuucaaggagaagguggacacgcgcacccaggagcccaaggaggggaccaagaagcucaugcggaucaccgcggaguggcuguggaaggagcugggcaagaagaagacgccccgcaugugcacccgggaggaguucacccgcaaggugcggagcaacgccgcccucggggccaucuucaccgacgagaacaaguggaaguccgcccgcgaggcggucgaggacggccgguucugggagcugguggacaaggagcgcaaccugcaccucgaggggaagugcgagacgugcguguacaacaugaugggcaagcgggagaagaagcugggcgaguucgggaaggccaagggcagccgcgccaucugguacauguggcugggggcccgguuccucgaguucgaggcgcugggcuuccugaacgaggaccacugguucucccgcgggaacagccucagcggcgucgagggcgaggggcugcaccggcugggcuacauccuccgcgacguggggaagaaggagggcggggccauguacgccgacgacaccgccggcugggacacccggaucacccuggaggaccugaagaacgaggagauggucacgaaccacaugaagggcgagcacaagaagcucgccgaggcgaucuucaagcugaccuaccagaacaagguggugcgcguccagcggccgacgccccgcgggaccgugauggacaucaucucccggcgcgaccagcgcggcagcggccagguggggacguacggccugaacaccuucaccaacauggaggcccagcucauccggcagauggagggggagggcaucuucaaguccauccagcaccugaccgccacggaggagaucgccguccagaacuggcuggcccgcguggggcgggagcgccucagccggauggcgaucuccggcgacgacugcguggucaagcccaucgacgaccgcuucgccagcgcccugaccgcccugaacgacauggggaaggugcggaaggacauccagcagugggagcccucccgcggcuggaacgacuggacccaggugccguucugcagccaccacuuccacgagcucgucaugaaggacggccgggugcuggugguccccugccgcaaccaggacgagcugaucgggcgggcccgcaucucccagggcgcgggguggagccucaaggagaccgccugccugggcaaguccuacgcccagauguggacccugauguacuuccaccggcgcgaccuccggcuggccgccaacgcgaucugcagcgccgugcccucccacugggugcccacgagccgcaccaccugguccauccacgccaagcacgaguggaugaccacggaggacaugcuggccgucuggaaccggguguggauccaggagaacccguggauggaggacaagacccccguggagagcugggaggagguccccuaccucgggaagcgcgaggaccaguggugcggcucccugaucggccugaccagccgggcgaccugggccaagaacauccagacggccaucaaccaggugcgcagccucaucgggaacgaggaguacaccgacuacaugcccuccaugaagcgcuuccggcgcgaggaggaggaggccggcgugcugugguga

SEQ ID NO: 9770 - RNA, 9876 nt, Artificial Sequence
  derived and/or modified CDS sequence (opt1) from DENV-2__HQ332185__SS-prME
accgccggcgugaucaucaugcugauccccaccgccauggcguuccaccucaccacccggaacggggagccccacaugaucgucggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcauccaguacgagggcgacggcucccccugcaagauccccuucgagaucaccgaccuggagaagcggcacgugcucgggcgccugaucaccgucaacccgaucgugaucgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcccuccaccagguguucggggcgaucuacggcgccgccuucagcggggucuccuggaccaugaagauccugaucggcguggugaucacguggaucgggaugaacagccgcuccaccagccuguccgucagccuggugcucgugggcgucgugacccuguaccugggggccauggugcaggcggacuccggcugcgucgugagcuggaagaucaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaccaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaagaacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgcgauccugcucguggccgugagcuucgucacccugaucaccgggaacauguccuuccgggaccugggccgcgugauggugauggucggggccaccaugacggacgacaucggcaugggcgugaccuaccucgcccugcuggccgcguucaaggugcgccccaccuucgccgccgggcuccugcugcggaagcucaccagcaaggagcugaugauggccacgaucggcaucacccugcucucccagagcaccauccccgagaccauccuggagcugacggacgcccucgcgcuggggaugaugguccugaagaucgugcgcaacauggagaaguaccagcucgccgugaccaucauggccaucuccugcgucccgaacgccgugauccugcggaacgccuggaaggugagcugcaccauccuggcggccgucuccgugagcccccuccugcugaccuccagccagcagaaggccgacuggaucccccucgcccugacgaucaagggccugaaccccaccgcgaucuuccucaccacccugucccgcacgagcaagaagcgguccuggccgcugaacgaggccaucauggccgucggcauggugagcauccucgccuccagccugcugaagaacgacauccccaugaccgggccccucguggccggcgggcugcugaccgucugcuacgugcucaccggccgcagcgcggaccuggagcuggagcgggccgccgacgugaagugggaggaccaggccgagaucuccgggagcucccccauccucagcaucacgaucuccgaggacggcagcauguccaucaagaacgaggaggaggagcagacccugaccauccugauccgcaccggccuccuggucaucagcgggguguucccgguguccauccccaucaccgccgcggccugguaccugugggaggucaagaagcagcgggccggcgugcucugggacgugcccagcccgccgcccgucgggaaggccgagcuggaggacggcgccuaccgcaucaagcagcgggggauccugggcuacucccagaucggcgcggggguguacaaggagggcacguuccacaccauguggcacgugacccgcggggccguccucaugcaccggggcaagcgcaucgagcccagcugggccgacgugaagaaggaccugaucuccuacgggggcggcuggaagcuggagggggaguggaaggagggcgaggaggugcagguccucgcccuggagcccgggaagaacccccgggccgugcagaccaagcccggcaucuucaagacgaacaccgggaccaucggcgcggugagccuggacuucucccccggcaccagcgggucccccaucgucgaccgcaagggcaaggugguggggcucuacggcaacggcgucgugacgcggagcggggccuacguguccgccaucgcccagaccgagaaguccaucgaggacaaccccgagaucgaggacgacaucuuccgcaagaagcggcugaccaucauggaccugcaccccggcgcggggaagaccaagcgcuaccuccccgccaucguccgggaggccaucaagcgcggccugcgcacgcugauccuggccccgacccgggugguggccgcggagauggaggaggcccuccgcgggcugcccauccgguaccagacccccgccaucaaggccgagcacaccggccgcgagaucgucgaccugaugugccacgccacguucaccaugcggcuccugagccccgugcgcgugccgaacuacaaccugaucaucauggacgaggcgcacuucaccgaccccgccuccaucgccgcccggggcuacaucagcacccgcgucgagaugggggaggccgcgggcaucuucaugacggccacgccgcccgggucccgggacccguucccccagagcaacgcccccaucauggacgaggagcgcgagauccccgagcgguccuggaacagcggccacgagugggugaccgacuucaaggggaagaccgugugguucgucccguccaucaaggccggcaacgacaucgcggccugccuccgcaagaacggcaagaaggugauccagcugagccggaagacguucgacuccgaguacgugaagacccgcgccaacgacugggacuucgucgugaccaccgacaucagcgagaugggggccaacuucaaggccgagcgggugaucgacccccgccggugcaugaagcccgucauccugacggacggcgaggagcgcgugauccucgcggggcccaugccggugacccacuccagcgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgcgagaaggucgacgcgaucgacggggaguaccggcugcgcggcgaggcccggaagaccuucguggaccugaugcgccgcggggaccuccccguguggcuggccuacaaggucgccgccgagggcaucaacuacgcggaccgcaaguggugcuucgacgggaucaagaacaaccagauccuggaggagaacguggagguggagaucuggacgaaggagggcgagcggaagaagcucaagccgcgcuggcuggacgcccggaucuacagcgacccccuggcccucaaggaguucaaggaguucgccgcgggccgcaagucccugacccugaaccucaucaccgagauggggcggcugcccaccuucaugacgcagaaggcccgcaacgcccuggacaaccucgccguccugcacaccgccgaggcgggcgggcgggccuacaaccacgcccugagcgagcuccccgagacccuggagacccugcuccugcugacgcuccuggccaccgugaccggcggcaucuuccuguuccucauguccgggaagggcaucgggaagaugacccugggcaugugcugcaucaucaccgccagcguccugcucugguacgcgcagauccagccgcacuggaucgccgccuccaucauccuggaguucuuccugaucgugcuccugauccccgagcccgagaagcagcgcacgccccaggacaaccagcugaccuacguggucaucgccauccucaccgugguggccgcgaccauggccaacgagaugggguuccuggagaagacgaagaaggaccugggccucggcagcaucaccacccaggagagcgaguccaacauccuggacaucgaccugcggccggccagcgccuggacccucuacgccgucgcgacgaccuucgugacccccaugcugcgccacuccaucgagaacagcuccgugaacgucagccugaccgccaucgccaaccaggccacggugcucauggggcugggcaagggguggccccuguccaagauggacaucggcgugccccuccuggcgaucgggugcuacagccaggucaacccgaucacccugaccgccgcccuccugcugcucguggcccacuacgccaucaucggccccggccugcaggcgaaggccacccgggaggcccagaagcgcgccgccgcggggaucaugaagaaccccacgguggacggcaucaccgucaucgaccuggagcccaucccguacgaccccaaguucgagaagcagcucggccaggugaugcugcugauccucugcgugacccagguccugaugaugcggaccacgugggcccugugcgaggcccucacccuggccaccggccccaucuccacccugugggaggggaaccccggccgcuucuggaacacgaccaucgccgugagcauggcgaacaucuuccgcggcuccuaccucgccggggccggccugcuguucagcaucaugaagaacaccaccaacacgcggcgcgggaccggcaacaucggcgagacccucggggagaaguggaagucccggcugaacgcccugggcaagagcgaguuccagaucuacaagaaguccgggauccaggagguggaccgcacccucgcgaaggagggcaucaagcgcggggagacggaccaccacgccgucagccgcggcuccgccaagcugcggugguucguggagcgcaacauggugaccccggagggcaaggucguggaccuggggugcggccgcggcggguggagcuacuacugcggcgggcucaagaacgugcgcgaggucaaggggcugaccaagggcggccccgggcacgaggagcccauccccauguccaccuacggcuggaaccuggugcggcuccagagcgggguggacgucuucuucacgccgcccgagaagugcgacacccugcugugcgacaucggcgagagcucccccaaccccaccaucgaggccggccgcacccuccgggugcugaaccugguggagaacuggcucaacaacaacacccaguucugcaucaagguccugaacccguacaugcccagcgugaucgagaagauggagacgcugcagcgcaaguacgggggcgcccucgugcggaacccccugucccgcaacagcacccacgagauguacugggucuccaacgcgaccgggaacaucgugagcuccgugaacaugaucagccggaugcugaucaaccgcuucaccaugaagcacaagaaggccacguacgagccggacgucgaccugggcuccgggacccggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggugaacggggugguccgccugcugaccaagcccugggacguggugccgauggucacccagauggccaugacggacaccacccccuucggccagcagcggguguucaaggagaagguggacacccgcacgcaggagcccaaggagggcaccaagaagcucaugcggaucaccgcggaguggcuguggaaggagcuggggaagaagaagacgccccggaugugcacgcgggaggaguucacccgcaagguccggagcaacgccgcccucggcgccaucuucaccgacgagaacaaguggaaguccgcccgcgaggcgguggaggacgggcgguucugggagcugguggacaaggagcgcaaccugcaccucgagggcaagugcgagaccugcgucuacaacaugauggggaagcgggagaagaagcugggcgaguucggcaaggccaaggggagccgcgccaucugguacauguggcugggcgcccgguuccucgaguucgaggcgcugggguuccugaacgaggaccacugguucucccgcggcaacagccucagcgggguggagggcgagggccugcaccggcugggguacauccuccgcgacgucggcaagaaggagggcggcgccauguacgccgacgacacggccgggugggacacccggaucacccuggaggaccugaagaacgaggagauggugaccaaccacaugaagggcgagcacaagaagcucgccgaggcgaucuucaagcugacguaccagaacaaggugguccgcgugcagcggccgacgccccgcggcaccgugauggacaucaucucccggcgcgaccagcgcgggagcggccaggucgggaccuacggccugaacacguucaccaacauggaggcccagcucauccggcagauggagggcgaggggaucuucaaguccauccagcaccugaccgccaccgaggagaucgccgugcagaacuggcuggcccgcgugggccgggagcgccucagccggauggcgaucuccggggacgacugcgucgugaagcccaucgacgaccgcuucgccagcgcccugacggcccugaacgacaugggcaaggugcggaaggacauccagcagugggagcccucccgcggguggaacgacuggacccaggucccguucugcagccaccacuuccacgagcucgugaugaaggacggccgggugcuggucgugcccugccgcaaccaggacgagcugaucggccgggcccgcaucucccagggggcgggcuggagccucaaggagaccgccugccuggggaaguccuacgcccagauguggacccugauguacuuccaccggcgcgaccuccggcuggccgccaacgcgaucugcagcgccgugcccucccacuggguccccaccagccgcacgaccugguccauccacgccaagcacgaguggaugaccaccgaggacaugcuggccguguggaaccggguguggauccaggagaacccguggauggaggacaagacgcccgucgagagcugggaggaggugcccuaccucggcaagcgcgaggaccaguggugcgggucccugaucggccugaccagccgggcgaccugggccaagaacauccagaccgccaucaaccaggugcgcagccucaucggcaacgaggaguacacggacuacaugcccuccaugaagcgcuuccggcgcgaggaggaggaggccgggguccugugguga

SEQ ID NO: 9771 - RNA, 9876 nt, Artificial Sequence
  derived and/or modified CDS sequence (opt1) from DENV-2__HQ332186__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagagccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaucgagaaggacagccccgugaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcggggucuucaccuccaucgggaaggcccuccaccagguguucggggcgaucuacggcgccgccuucagcgggguguccuggaccaugaagauccugaucggcgucgugaucacguggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaccaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucgggguguucaccaccaacaucuggcucaagcugcgcgagaagcaggacgucuucugcgacuccaagcugaugagcgccgccaucaaggacaaccgggcggugcacgccgacaugggcuacuggaucgaguccgcccucaacgacaccuggaagauggagaaggccagcuucaucgaggugaaguccugccacuggcccaagagccacaccuucugguccaacggcguccuggagagcgagaugaucauccccaagaacuucgccgggcccgugucccagcacaacuaccgcccgggcuaccacacgcagaucgcggggcccuggcaccugggcaagcucgagauggacuucgacuucugcgaggggaccaccguggucgugaccgaggacugcggcaaccggggccccagccugcgcacgaccaccgccagcgggaagcugaucaccgaguggugcugccgguccugcacgcucccgccccugcgcuaccggggcgaggacgggugcugguacggcauggagauccgcccccugaaggagaaggaggagaaccucgugaacagccuggucaccgccgggcacggccagaucgacaacuucucccugggcgugcucgggauggcccuguuccuggaggagaugcuccggacccgcgugggcaccaagcacgcgauccugcuggucgccgugagcuucgugacgcucaucaccgggaacauguccuuccgggaccugggccgcgucauggugauggugggggccaccaugaccgacgacaucggcaugggcgucacguaccuggcccuccuggccgcguucaaggugcgccccaccuucgccgccgggcugcuccugcggaagcugaccagcaaggagcucaugauggccaccaucggcaucacgcugcugucccagagcaccauccccgagaccauccucgagcugaccgacgcccuggcgcucgggaugauggugcugaagaucguccgcaacauggagaaguaccagcuggccgugacgaucauggccaucuccugcgugcccaacgccgucauccuccggaacgccuggaaggugagcugcaccauccuggcggccgucuccgugagcccccugcuccugaccuccagccagcagaaggccgacuggaucccccuggcccucaccaucaagggccugaaccccacggcgaucuuccugaccacccucucccgcaccagcaagaagcgguccuggccgcugaacgaggccaucauggccgugggcauggucagcauccuggccuccagccuccugaagaacgacauccccaugacggggccccugguggccggcgggcuccugaccgugugcuacguccugaccggccgcagcgcggaccucgagcuggagcgggccgccgacgugaagugggaggaccaggccgagaucuccgggagcucccccauccugagcaucaccaucuccgaggacggcagcauguccaucaagaacgaggaggaggagcagacgcucaccauccugauccgcaccggccugcucgugaucagcggggucuucccgguguccauccccaucaccgccgcggccugguaccugugggaggugaagaagcagcgggccggcguccugugggacgugcccuccccgccgcccguggggaaggccgagcucgaggacggcgccuaccgcaucaagcagcgggggauccugggcuacucccagaucggcgcgggggucuacaaggagggcaccuuccacacgauguggcacgugacccgcggggccgugcugaugcaccggggcaagcgcaucgagcccagcugggccgacgucaagaaggaccucaucuccuacgggggcggcuggaagcuggagggggaguggaaggagggcgaggagguccaggugcuggcccucgagcccgggaagaacccccgggccguccagaccaagcccggcaucuucaagaccaacacggggaccaucggcgcggugagccuggacuucucccccggcaccagcgggucccccaucguggaccgcaagggcaaggucguggggcuguacggcaacggcguggucacccggagcggggccuacguguccgccaucgcccagacggagaaguccaucgaggacaaccccgagaucgaggacgacaucuuccgcaagaagcggcucaccaucauggaccugcaccccggcgcggggaagaccaagcgcuaccugcccgccaucgugcgggaggccaucaagcgcggccuccgcacccugauccuggccccgacgcgggucguggccgcggagauggaggaggcccugcgcgggcuccccauccgguaccagacccccgccaucaaggccgagcacaccggccgcgagaucguggaccugaugugccacgccaccuucacgaugcggcugcucagccccguccgcgugccgaacuacaaccugaucaucauggacgaggcgcacuucaccgaccccgccuccaucgccgcccggggcuacaucagcacccgcguggagaugggggaggccgcgggcaucuucaugaccgccacgccgcccgggucccgggacccguucccccagagcaacgcccccaucauggacgaggagcgcgagauccccgagcgguccuggaacagcggccacgagugggucaccgacuucaaggggaagaccgugugguucgugccguccaucaaggccggcaacgacaucgcggccugccugcgcaagaacggcaagaaggucauccagcucagccggaagaccuucgacuccgaguacgugaagacgcgcgccaacgacugggacuucguggucaccaccgacaucagcgagaugggggccaacuucaaggccgagcgggugaucgacccccgccggugcaugaagcccgugauccugaccgacggcgaggagcgcgucauccuggcggggcccaugccggugacgcacuccagcgccgcccagcggcgcggccgcaucgggcggaaccccaagaacgagaacgaccaguacaucuacaugggcgagccccucgagaacgacgaggacugcgcccacuggaaggaggccaagaugcugcuggacaacaucaacacccccgagggcaucaucccguccauguucgagcccgagcgcgagaagguggacgcgaucgacggggaguaccggcuccgcggcgaggcccggaagaccuucgucgaccugaugcgccgcggggaccugcccguguggcucgccuacaagguggccgccgagggcaucaacuacgcggaccgcaaguggugcuucgacgggaucaagaacaaccagauccuggaggagaacgucgagguggagaucuggaccaaggagggcgagcggaagaagcugaagccgcgcuggcucgacgcccggaucuacagcgacccccuggcccugaaggaguucaaggaguucgccgcgggccgcaagucccucacgcugaaccugaucaccgagauggggcggcuccccaccuucaugacccagaaggcccgcaacgcccuggacaaccuggccguccuccacacggccgaggcgggcgggcgggccuacaaccacgcccugagcgagcugcccgagacccucgagacccugcugcuccugacccugcucgccacggugaccggcggcaucuuccuguuccugauguccgggaagggcaucgggaagaugacccucggcaugugcugcaucaucaccgccagcgugcugcugugguacgcgcagauccagccgcacuggaucgccgccuccaucauccucgaguucuuccugaucguccugcucauccccgagcccgagaagcagcgcacgccccaggacaaccagcugacguacguggugaucgccauccugaccgucguggccgcgaccauggccaacgagaugggguuccucgagaagaccaagaaggaccugggccugggcagcaucacgacccaggagccggagagcaacauccucgacaucgaccugcggcccgccuccgccuggacccuguacgccguggcgaccacguucgucacccccaugcuccgccacagcaucgagaacuccagcgugaacgugucccugaccgccaucgccaaccaggccaccguccugauggggcucggcaagggguggccccugagcaagauggacaucggcgugccgcugcucgcgaucgggugcuacucccaggugaaccccaucacgcugaccgccgcccugcuccugcuggucgcccacuacgccaucaucggccccggccuccaggcgaaggccacccgggaggcccagaagcgcgccgccgcggggaucaugaagaaccccaccguggacggcaucacggugaucgaccuggagccgauccccuacgaccccaaguucgagaagcagcuggggcaggucaugcuccugauccugugcgugacccaggugcucaugaugcggaccaccugggcccugugcgaggcccugacgcucgccaccggccccaucagcacccugugggaggggaacccgggccgcuucuggaacaccacgaucgccgucuccauggcgaacaucuuccgcggcagcuaccuggccggggccggccuccuguucuccaucaugaagaacaccaccaacacccggcgcgggacgggcaacaucggcgagacccugggggagaaguggaagucccggcucaacgcccugggcaaguccgaguuccagaucuacaagaaguccgggauccaggagguggaccgcacccuggcgaaggagggcaucaagcgcggggagaccgaccaccacgccgugucccgcggcagcgccaagcuccggugguucgucgagcgcaacauggugacgcccgagggcaagguggucgaccuggggugcggccgcggcgggugguccuacuacugcggcgggcugaagaacgugcgcgaggugaaggggcucaccaagggcggccccgggcacgaggagcccaucccgaugagcaccuacggcuggaaccugguccggcugcaguccgggguggacguguucuucacgccgcccgagaagugcgacacgcuccugugcgacaucggcgagagcagccccaacccgaccaucgaggccggccgcacccugcggguccucaaccugguggagaacuggcugaacaacaacacccaguucugcaucaaggugcucaaccccuacaugcccuccgucaucgagaagauggagacccugcagcgcaaguacgggggcgcccuggugcggaacccgcucagccgcaacuccacgcacgagauguacugggugagcaacgcgaccgggaacaucgucuccagcgugaacaugaucucccggaugcugaucaaccgcuucaccaugaagcacaagaaggccaccuacgagcccgacguggaccugggcagcgggacgcggaacaucggcaucgaguccgagauccccaaccuggacaucaucggcaagcgcaucgagaagaucaagcaggagcacgagaccagcuggcacuacgaccaggaccacaccuacaagaccugggccuaccacggguccuacgagacgaagcagaccggcagcgccuccagcauggucaacgggguggugcgccuccugaccaagcccugggacgucgugccgauggugacccagauggccaugacggacaccacccccuucggccagcagcgggucuucaaggagaagguggacacccgcacgcaggagcccaaggagggcaccaagaagcugaugcggaucaccgcggaguggcucuggaaggagcuggggaagaagaagacgccccggaugugcacgcgggaggaguucacccgcaaggugcgguccaacgccgcccugggcgccaucuucaccgacgagaacaaguggaaguccgcccgcgaggcggucgaggacgggcgguucugggagcucguggaccgcgagcggaaccugcaccuggagggcaagugcgagaccugcgucuacaacaugauggggaagcgcgagaagaagcucggcgaguucggcaaggccaaggggucccgggccaucugguacauguggcugggcgcccgcuuccuggaguucgaggcgcucggguuccugaacgaggaccacugguucagccggggcaacucccugagcgggguggagggcgagggccuccaccgccugggguacauccugcgggacgugggcaagaaggagggcggcgccauguacgccgacgacacggccgggugggacacccgcaucacccucgaggaccugaagaacgaggagauggucaccaaccacaugaagggcgagcacaagaagcuggccgaggcgaucuucaagcucacguaccagaacaagguggugcggguccagcgcccgacgccccggggcaccgugauggacaucaucagccgccgcgaccagcggggguccggccagguggggaccuacggccugaacaccuucaccaacauggaggcccagcugauccgccagauggagggcgaggggaucuucaagagcauccagcaccucaccgucaccgaggagaucgccgugcagaacuggcuggcccgggugggccgcgagcggcugucccgcauggccaucagcggggacgacugcgucgugaagcccaucgacgaccgguucgcguccgcccucacggcccugaacgacaugggcaaggugcgcaaggacauccagcagugggagcccagccggggguggaacgacuggacccaggucccguucugcucccaccacuuccacgagcuggugaugaaggacggccgcgugcucgucgugcccugccggaaccaggacgagcugaucggccgcgcccggaucagccagggggccggcuggucccugaaggagaccgcgugccucggcaagagcuacgcccagauguggacccugauguacuuccaccgccgggaccugcgccucgccgccaacgccaucugcuccgcggugcccagccacuggguccccaccucccggacgaccuggagcauccacgccaagcacgaguggaugaccaccgaggacaugcuggccguguggaaccgcguguggauccaggagaacccguggauggaggacaagacgcccgucgaguccugggaggaggugcccuaccugggcaagcgggaggaccaguggugcgggagccucaucggccugaccucccgcgccaccugggcgaagaacauccagaccgccaucaaccaggugcgcagccugaucggcaacgaggaguacacggacuacaugcccagcaugaagcgguuccgccgggaggaggaggaggccgggguccucugguga

SEQ ID NO: 9772 - RNA, 9876 nt, Artificial Sequence
  derived and/or modified CDS sequence (opt1) from DENV-2__HQ332187__SS-prME
accgccggcgugaucaucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggugaccuacgggaccugcaccaccacgggcgagcaccggcgcgagaagcgguccgucgcccuggugccccacguggggaugggccucgagacccgcaccgagaccuggaugagcuccgagggggccuggaagcacguccagcggaucgagaccuggauccugcgccacccgggcuucaccaucauggccgcgauccuggccuacaccaucgggaccacgcacuuccagcgggcccucaucuucauccugcugaccgccguggcgcccagcaugaccaugcgcugcaucggcaucuccaaccgggacuucguggagggcgucagcgggggcuccuggguggacaucgugcucgagcacgggagcugcgucaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaaggucgugcagcccgagaaccuggaguacaccaucgugaucacgccccacagcggggaggagcacgccgucggcaacgacaccgggaagcacggcaaggagaucaagaucaccccgcaguccagcaucaccgaggccgagcugaccggguacggcacggugaccauggagugcagcccccggaccggccucgacuucaacgagauggugcugcugcagauggaggacaaggccuggcucguccaccggcagugguuccuggaccugccccuccccuggcugccgggggccgacacccagggcagcaacuggauccagaaggagacgcuggugaccuucaagaacccccacgcgaagaagcaggacguggucgugcucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgucaaggagaucgccgagacccagcacgggacgaucgugauccgcauccaguacgagggcgacggcucccccugcaagauccccuucgagaucaccgaccuggagaagcggcacgugcucgggcgccugaucaccgucaacccgaucgugaucgagaaggacagccccgugaacaucgaggcggagccgcccuucggcgacuccuacaucaucaucggggucgagccgggccagcugaagcucaacugguucaagaaggggagcuccaucggccagauguucgagaccacgaugcgcggcgccaagcggauggccauccugggggacaccgccugggacuucggcagccucggcgggguguucaccuccaucgggaaggcccuccaccagguguucggggcgaucuacggcgccgccuucagcggggucuccuggaccaugaagauccugaucggcguggugaucacguggaucgggaugaacagccgcuccaccagccuguccgucagccuggugcucgugggcgucgugacccuguaccugggggccauggugcaggcggacuccggcugcgucgugagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucacgaucaugaccggcgacaccaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacgcagaccgcggggcccuggcaccucggcaagcuggagauggacuucgacuucugcgaggggaccaccgucguggugacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgcgauccugcucguggccgugagcuucgucacccugaucaccgggaacauguccuuccgggaccugggccgcgugauggugauggucggggccaccaugacggacgacaucggcaugggcgugaccuaccucgcccugcuggccgcguucaaggugcgccccaccuucgccgccgggcuccugcugcggaagcucaccagcaaggagcugaugauggccacgaucggcaucacccugcucucccagagcaccauccccgagaccauccuggagcugacggacgcccucgcgcuggggaugaugauccugaagaucguccgcaacauggagaaguaccagcucgccgugaccaucauggccaucuccugcgugccgaacgccgucauccugcggaacgccuggaaggugagcugcaccauccuggcggccguguccgucagcccccuccugcugaccuccagccagcagaaggccgacuggaucccccucgcccugacgaucaagggccugaaccccaccgcgaucuuccucaccacccugucccgcacgagcaagaagcgguccuggccgcugaacgaggccaucauggccgugggcauggucagcauccucgccuccagccugcugaagaacgacauccccaugaccgggccccucguggccggcgggcugcugaccgugugcuacguccucaccggccgcagcgcggaccuggagcuggagcgggccgccgacgugaagugggaggaccaggccgagaucuccgggagcucccccauccucagcaucacgaucuccgaggacggcagcauguccaucaagaacgaggaggaggagcagacccugaccauccugauccgcaccggccuccuggugaucagcggggucuucccgguguccauccccaucaccgccgcggccugguaccugugggaggugaagaagcagcgggccggcguccucugggacgugcccagcccgccgcccguggggaaggccgagcuggaggacggcgccuaccgcaucaagcagcgggggauccugggcuacucccagaucggcgcgggggucuacaaggagggcacguuccacaccauguggcacgugacccgcggggccgugcucaugcaccggggcaagcgcaucgagcccagcugggccgacgucaagaaggaccugaucuccuacgggggcggcuggaagcuggagggggaguggaaggagggcgaggagguccaggugcucgcccuggagcccgggaagaacccccgggccguccagaccaagcccggcaucuucaagacgaacaccgggaccaucggcgcggugagccuggacuucucccccggcaccagcgggucccccaucguggaccgcaagggcaaggucguggggcucuacggcaacggcguggucacgcggagcggggccuacguguccgccaucgcccagaccgagaaguccaucgaggacaaccccgagaucgaggacgacaucuuccgcaagaagcggcugaccaucauggaccugcaccccggcgcggggaagaccaagcgcuaccuccccgugaucguccgggaggccaucaagcgcggccugcgcacgcugauccuggccccgacccgggugguggccgccgagauggaggaggcgcuccgcgggcugcccauccgguaccagacccccgccaucaaggccgagcacaccggccgcgagaucgucgaccugaugugccacgccacguucaccaugcggcuccugagccccgugcgcgugccgaacuacaaccugaucaucauggacgaggcccacuucaccgaccccgcguccaucgccgcccggggcuacaucagcacccgcgucgagaugggggaggccgccggcaucuucaugacggcgacgccgcccgggucccgggacccguucccccagagcaacgcccccaucauggacgaggagcgcgagauccccgagcgguccuggaacagcggccacgagugggugaccgacuucaaggggaagaccgugugguucgucccguccaucaaggccggcaacgacaucgccgcgugccuccgcaagaacggcaagaaggugauccagcugagccggaagacguucgacuccgaguacgugaagacccgcgccaacgacugggacuucgucgugaccaccgacaucagcgagaugggggccaacuucaaggccgagcgggugaucgacccccgccggugcaugaagcccgucauccugacggacggcgaggagcgcgugauccucgccgggcccaugccggugacccacuccagcgcggcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgcgagaaggucgacgccaucgacggggaguaccggcugcgcggcgaggcgcggaagaccuucguggaccugaugcgccgcggggaccuccccguguggcuggccuacaaggucgccgccgagggcaucaacuacgccgaccgcaaguggugcuucgacgggaucaagaacaaccagauccuggaggagaacguggagguggagaucuggacgaaggagggcgagcggaagaagcucaagccgcgcuggcuggacgcgcggaucuacagcgacccccuggcccucaaggaguucaaggaguucgccgccggccgcaagucccugacccugaaccucaucaccgagauggggcggcugcccaccuucaugacgcagaaggcgcgcaacgcccuggacaaccucgccguccugcacaccgccgaggccggcgggcgggcguacaaccacgcccugagcgagcuccccgagacccuggagacccugcuccugcugacgcuccuggccaccgugaccggcggcaucuuccuguuccucauguccgggaagggcaucgggaagaugacccugggcaugugcugcaucaucaccgccagcguccugcucugguacgcccagauccagccgcacuggaucgcggccuccaucauccuggaguucuuccugaucgugcuccugauccccgagcccgagaagcagcgcacgccccaggacaaccagcugaccuacguggucaucgccauccucaccgugguggccgccaccauggcgaacgagaugggguuccuggagaagacgaagaaggaccugggccucggcagcaucaccacccaggagagcgaguccaacauccuggacaucgaccugcggccggccagcgccuggacccucuacgccgucgccacgaccuucgugacccccaugcugcgccacuccaucgagaacagcuccgugaacgucagccugaccgcgaucgccaaccaggccacggugcucauggggcugggcaagggguggccccuguccaagauggacaucggcgugccccuccuggccaucgggugcuacagccaggucaacccgaucacccugaccgcggcccuccugcugcucguggcccacuacgccaucaucggccccggccugcaggccaaggcgacccgggaggcccagaagcgcgccgccgccgggaucaugaagaaccccacgguggacggcaucaccgucaucgaccuggagcccaucccguacgaccccaaguucgagaagcagcucggccaggugaugcugcugauccucugcgugacccagguccugaugaugcggaccacgugggcgcugugcgaggcccucacccuggccaccggccccaucuccacccugugggaggggaaccccggccgcuucuggaacacgaccaucgccgugagcauggccaacaucuuccgcggcuccuaccucgcgggggccggccugcuguucagcaucaugaagaacaccaccaacacgcggcgcgggaccggcaacaucggcgagacccucggggagaaguggaagucccggcugaacgcccugggcaagagcgaguuccagaucuacaagaaguccgggauccaggagguggaccgcacccucgccaaggagggcaucaagcgcggggagacggaccaccacgcggucagccgcggcuccgccaagcugcggugguucguggagcgcaacauggugaccccggagggcaaggucguggaccuggggugcggccgcgggggcuggagcuacuacugcgggggccucaagaacgugcgcgaggucaagggccugaccaagggcggccccgggcacgaggagcccauccccauguccaccuacggcuggaaccuggugcggcuccagagcgggguggacgucuucuucacgccgcccgagaagugcgacacccugcugugcgacaucggcgagagcucccccaaccccaccaucgaggccggccgcacccuccgggugcugaaccugguggagaacuggcucaacaacaacacccaguucugcaucaagguccugaacccguacaugcccagcgugaucgagaagauggagacgcugcagcgcaaguacgggggcgcccucgugcggaacccccugucccgcaacagcacccacgagauguacugggucuccaacgccaccgggaacaucgugagcuccgugaacaugaucagccggaugcugaucaaccgcuucaccaugaagcacaagaaggcgacguacgagccggacgucgaccugggcuccgggacccggaacaucggcaucgagagcgagauccccaaccucgacaucaucggcaagcgcaucgagaagaucaagcaggagcacgagaccuccuggcacuacgaccaggaccaccccuacaagaccugggccuaccacgggagcuacgagacgaagcagaccggcuccgccagcuccauggugaacggggugguccgccugcugaccaagcccugggacguggugccgauggucacccagauggccaugacggacaccacccccuucggccagcagcggguguucaaggagaagguggacacccgcacgcaggagcccaaggagggcaccaagaagcucaugcggaucaccgccgaguggcuguggaaggagcuggggaagaagaagacgccccggaugugcacgcgggaggaguucacccgcaagguccggagcaacgcggcccucggcgccaucuucaccgacgagaacaaguggaaguccgcccgcgaggccguggaggacgggcgguucggcgagcugguggacaaggagcgcaaccugcaccucgaggggaagugcgagaccugcgucuacaacaugaugggcaagcgggagaagaagcugggcgaguucgggaaggcgaagggcagccgcgccaucugguacauguggcugggggcccgguuccucgaguucgaggcccugggcuuccugaacgaggaccacugguucucccgcgggaacagccucagcggcguggagggcgaggggcugcaccggcugggcuacauccuccgcgacgucgggaagaaggagggcggggcgauguacgccgacgacacggccggcugggacacccggaucacccuggaggaccugaagaacgaggagauggugaccaaccacaugaagggcgagcacaagaagcucgccgaggccaucuucaagcugacguaccagaacaaggugguccgcgugcagcggccgacgccccgcgggaccgugauggacaucaucucccggcgcgaccagcgcggcagcgggcaggucggcaccuacggccugaacacguucaccaacauggaggcgcagcucauccggcagauggagggggagggcaucuucaaguccauccagcaccugaccgccaccgaggagaucgccgugcagaacuggcuggcccgcguggggcgggagcgccucagccggauggccaucuccggcgacgacugcgucgugaagcccaucgacgaccgcuucgcgagcgcccugacggcccugaacgacauggggaaggugcggaaggacauccagcagugggagcccucccgcggcuggaacgacuggacccaggucccguucugcagccaccacuuccacgagcucgugaugaaggacggccgggugcuggucgugcccugccgcaaccaggacgagcugaucgggcgggcccgcaucucccagggcgccggguggagccucaaggagaccgcgugccugggcaaguccuacgcccagauguggacccugauguacuuccaccggcgcgaccuccggcuggccgccaacgccaucugcagcgcggugcccucccacuggguccccaccagccgcacgaccugguccauccacgccaagcacgaguggaugaccaccgaggacaugcuggccguguggaaccggguguggauccaggagaacccguggauggaggacaagacgcccgucgagagcugggaggaggugcccuaccucgggaagcgcgaggaccaguggugcggcucccugaucggccugaccagccgggccaccugggcgaagaacauccagaccgccaucaaccaggugcgcagccucaucgggaacgaggaguacacggacuacaugcccuccaugaagcgcuuccggcgcgaggaggaggaggccggcguccugugguga

SEQ ID NO: 9773 - RNA, 9876 nt, Artificial Sequence
  derived and/or modified CDS sequence (opt1) from DENV-2__HQ332188__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccggaccgagaccuggaugagcagcgagggggccuggaagcacgugcagcggaucgagacguggauccugcgccaccccggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaucgagaaggacagccccgugaacaucgaggcggagccgcccuucggcgacuccuacaucaucaucgggguggagccgggccagcugaagcucaacugguucaagaaggggagcuccaucggccagauguucgagaccacgaugcgcggcgccaagcggauggccauccugggggacaccgccugggacuucggcagccucggcggggucuucaccuccaucgggaaggcccuccaccagguguucggggcgaucuacggcgccgccuucagcgggguguccuggaccaugaagauccugaucggcgucgugaucacguggaucgggaugaacagccgcuccaccagccuguccgugagccugguccucgugggcguggucacccuguaccugggggccauggugcaggcggacuccggcugcguggucagcuggaagaacaaggagcucaagugcggcuccgggaucuucaucaccgacaacgugcacacguggaccgagcaguacaaguuccagcccgagagccccagcaagcuggccuccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaccaagggggugaugcaggccggcaagcggagccugcgcccgcagcccaccgagcugaaguacuccuggaagacguggggcaaggcgaagaugcucagcaccgagucccacaaccagaccuuccugaucgacgggcccgagaccacggagugcccgaacaccaaccgggccuggaacagccuggagguggaggacuacggcuucggggucuucaccaccaacaucuggcucaagcugcgcgagaagcaggacguguucugcgacuccaagcugaugagcgccgccaucaaggacaaccgggccgugcacgcggacaugggcuacuggaucgaguccgcccucaacgacaccuggaagauggagaaggccagcuucaucgaggucaaguccugccacuggcccaagagccacacgcugugguccaacggcgugcuggagagcgagaugaucauccccaagaacuucgccgggcccgugucccagcacaacuaccgcccgggcuaccacacccagaucgccgggcccuggcaccucggcaagcuggagauggacuucgacuucugcgaggggaccaccgucguggugacggaggacugcggcaaccggggccccagccugcgcaccaccaccgcgagcgggaagcucaucacggaguggugcugccgguccugcacccugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcacgaagcacgccauccugcucguggcggugagcuucgucacccugaucaccgggaacauguccuuccgggaccugggccgcgugauggugauggucggggccaccaugacggacgacaucggcaugggcgccaccuaccucgcccugcuggccgcguucaaggugcgccccaccuucgccgccgggcuccugcugcggaagcucaccagcaaggagcugaugauggccacgaucggcaucacccugcucucccagagcaccauccccgagaccauccuggagcugacggacgcccucgcgcuggggaugauggugcugaagaucguccgcaacauggagaaguaccagcucgccgugaccaucauggccaucuccugcgugccgaacgccgucauccugcggaacgccuggaaggugagcugcaccauccuggcggccgucuccgugagcccccuccugcugaccuccagccagcagaaggccgacuggaucccccucgcccugacgaucaagggccugaaccccaccgcgaucuuccucaccacccugucccgcacgagcaagaagcgguccuggccgcugaacgaggccaucauggccgugggcauggucagcauccucgccuccagccugcugaagaacgacauccccaugaccgggccccucguggccggcgggcugcugaccgugugcuacguccucaccggccgcagcgcggaccuggagcuggagcgggccgccgacgugaagugggaggaccaggccgagaucuccgggagcucccccauccucagcaucacgaucuccgaggacggcagcauguccaucaagaacgaggaggaggagcagacccugaccauccugauccgcaccggccuccuggugaucagcggggucuucccgguguccauccccaucaccgccgcggccugguaccugugggaggugaagaagcagcgggccggcguccucugggacgugcccagcccgccgcccguggggaaggccgagcuggaggacggcgccuaccgcaucaagcagcgggggauccugggcuacucccagaucggcgcgggggucuacaaggagggcacguuccacaccauguggcacgugacccgcggggccgugcucaugcaccggggcaagcgcaucgagcccagcugggccgacgucaagaaggaccugaucuccuacgggggcggcuggaagcuggagggggaguggaaggagggcgaggagauccaggugcucgcccuggagcccgggaagaacccccgggccgugcagaccaagcccggcaucuucaagacgaacaccgggaccaucggcgcggucagccuggacuucucccccggcaccagcgggucccccaucguggaccgcaagggcaagguggucgggcucuacggcaacggcguggugacgcggagcggggccuacgucuccgccaucgcccagaccgagaaguccaucgaggacaaccccgagaucgaggacgacaucuuccgcaagaagcggcugaccaucauggaccugcaccccggcgcggggaagaccaagcgcuaccuccccgccaucgugcgggaggccaucaagcgcggccugcgcacgcugauccuggccccgacccggguggucgccgcggagauggaggaggcccuccgcgggcugcccauccgguaccagacccccgccaucaaggccgagcacaccggccgcgagaucguggaccugaugugccacgccacguucaccaugcggcuccugagccccgugcgcgucccgaacuacaaccugaucaucauggacgaggcgcacuucaccgaccccgccuccaucgccgcccggggcuacaucagcacccgcguggagaugggggaggccgcgggcaucuucaugacggccacgccgcccgggucccgggacccguucccccagagcaacgcccccaucauggacgaggagcgcgagauccccgagcgguccuggaacagcggccacgagugggugaccgacuucaaggggaagaccgucugguucgugccguccaucaaggccggcaacgacaucgcggccugccuccgcaagaacggcaagaaggugauccagcugagccggaagacguucgacuccgaguacgucaagacccgcgccaacgacugggacuucguggugaccaccgacaucagcgagaugggggccaacuucaaggccgagcgggucaucgacccccgccggugcaugaagcccgugauccugacggacggcgaggagcgcgugauccucgcggggcccaugccggucacccacuccagcgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgcgagaagguggacgcgaucgacggggaguaccggcugcgcggcgaggcccggaagaccuucguggaccugaugcgccgcggggaccuccccgucuggcuggccuacaagguggccgccgagggcaucaacuacgcggaccgcaaguggugcuucgacgggaucaagaacaaccagauccuggaggagaacguggaggucgagaucuggacgaaggagggcgagcggaagaagcucaagccgcgcuggcuggacgcccggaucuacagcgacccccuggcccucaaggaguucaaggaguucgccgcgggccgcaagucccugacccugaaccucaucaccgagauggggcggcugcccaccuucaugacgcagaaggcccgcaacgcccuggacaaccucgccgugcugcacaccgccgaggcgggcgggcgggccuacaaccacgcccugagcgagcuccccgagacccuggagacccugcuccugcugacgcuccuggccaccgucaccggcggcaucuuccuguuccucauguccgggaagggcaucgggaagaugacccugggcaugugcugcaucaucaccgccagcgugcugcucugguacgcgcagauccagccgcacuggaucgccgccuccaucauccuggaguucuuccugaucgugcuccugauccccgagcccgagaagcagcgcacgccccaggacaaccagcugaccuacgucgugaucgccauccucaccguggucgccgcgaccauggccaacgagaugggguuccuggagaagacgaagaaggaccugggccucggcagcaucaccacccaggagccggagagcaacauccuggacaucgaccugcggcccgccuccgccuggacccucuacgccguggcgacgaccuucgugacccccaugcugcgccacagcaucgagaacuccagcgucaacgugucccugaccgccaucgccaaccaggccacggugcucauggggcugggcaagggguggccccugagcaagauggacaucggcgucccgcuccuggcgaucgggugcuacucccaggugaaccccaucacccugaccgccgcccuccugcugcucguggcccacuacgccaucaucggccccggccugcaggcgaaggccacccgggaggcccagaagcgcgccgccgcggggaucaugaagaaccccacggucgacggcaucaccgugaucgaccuggagccgauccccuacgaccccaaguucgagaagcagcucgggcaggucaugcugcugauccucugcgucacccaggugcugaugaugcggaccacgugggcccugugcgaggcccucacccuggccaccggccccaucagcacccugugggaggggaacccgggccgcuucuggaacacgaccaucgccguguccauggcgaacaucuuccgcggcagcuaccucgccggggccggccugcuguucuccaucaugaagaacaccaccaacacgcggcgcgggaccggcaacaucggcgagacccucggggagaaguggaagucccggcugaacgcccugggcaaguccgaguuccagaucuacaagaaguccgggauccaggaggucgaccgcacccucgcgaaggagggcaucaagcgcggggagacggaccaccacgccgugucccgcggcagcgccaagcugcggugguucguggagcgcaacauggucacccccgagggcaaggugguggaccuggggugcggccgcggcgggugguccuacuacugcggcgggcucaagaacguccgcgaggugaaggggcugaccaagggcggccccgggcacgaggagcccaucccgaugagcaccuacggcuggaaccuggugcggcuccaguccggggucgacguguucuucacgccgcccgagaagugcgacacccugcugugcgacaucggcgagagcagccccaacccgaccaucgaggccggccgcacccuccgggugcugaaccuggucgagaacuggcucaacaacaacacccaguucugcaucaaggugcugaaccccuacaugcccuccgugaucgagaagauggagacgcugcagcgcaaguacgggggcgcccucguccggaacccgcugagccgcaacuccacccacgagauguacugggugagcaacgcgaccgggaacaucguguccagcgucaacaugaucucccggaugcugaucaaccgcuucaccaugaagcacaagaaggccacguacgagcccgacguggaccugggcagcgggacccggaacaucggcaucgaguccgagauccccaaccucgacaucaucggcaagcgcaucgagaagaucaagcaggagcacgagaccagcuggcacuacgaccaggaccaccccuacaagaccugggccuaccacggguccuacgagacgaagcagaccggcagcgccuccagcauggugaacggggucgugcgccugcugaccaagccgugggacgugguccccauggugacccagauggccaugacggacaccacccccuucggccagcagcggguguucaaggagaaggucgacacccgcacgcaggagcccaaggagggcaccaagaagcucaugcggaucaccgcggaguggcuguggaaggagcuggggaagaagaagaccccgcgcaugugcacgcgggaggaguucacccgcaaggugcgguccaacgccgcccucggcgccaucuucaccgacgagaacaaguggaaguccgcccgcgaggcgguggaggacgggcgguucugggagcuggucgaccgcgagcggaaccugcaccucgagggcaagugcgagaccugcguguacaacaugauggggaagcgcgagaagaagcugggcgaguucggcaaggccaaggggucccgggccaucugguacauguggcugggcgcccgcuuccucgaguucgaggcgcugggguuccugaacgaggaccacugguucagccggggcaacucccucagcggggucgagggcgagggccugcaccgccugggguacauccuccgggacgugggcaagaaggagggcggcgccauguacgccgacgacacggccgggugggacacccgcaucacccuggaggaccugaagaacgaggagauggugaccaaccacaugaagggcgagcacaagaagcucgccgaggcgaucuucaagcugacguaccagaacaaggucgugcgggugcagcgccccacgccccggggcaccgucauggacaucaucagccgccgcgaccagcggggguccggccagguggggaccuacggccugaacacguucaccaacauggaggcccagcucauccgccagauggagggcgaggggaucuucaagagcauccagcaccugaccgugaccgaggagaucgccguccagaacuggcuggcccgggugggccgcgagcggcucucccgcauggccaucagcggggacgacugcguggucaagcccaucgacgaccgguucgcguccgcccugacggcccugaacgacaugggcaaggugcgcaaggacauccagcagugggagccgagccggggguggaacgacuggacccaggugcccuucugcucccaccacuuccacgagcucgucaugaaggacggccgcgugcuggugguccccugccggaaccaggacgagcugaucggccgcgcccggaucagccagggggccggcuggucccucaaggagaccgcgugccugggcaagagcuacgcccagauguggacccugauguacuuccaccgccgggaccuccgccuggccgccaacgccaucugcuccgcggugcccagccacugggugccgaccucccggacgaccuggagcauccacgccaagcacgaguggaugaccaccgaggacaugcuggccgucuggaaccgcguguggauccaggagaaccccuggauggaggacaagacgcccguggaguccugggaggagguccccuaccucggcaagcgggaggaccaguggugcgggagccugaucggccugaccucccgcgccaccugggcgaagaacauccagaccgccaucaaccaggugcgcagccucaucggcaacgaggaguacacggacuacaugccgagcaugaagcgguuccgccgggaggaggaggaggccggggugcugugguga

SEQ ID NO: 9774 - RNA, 9876 nt, Artificial Sequence
  derived and/or modified CDS sequence (opt1) from DENV-2__HQ332189__SS-prME
accgccggcgugaucgucaugcugauccccaccgccauggcguuccaccucaccacccgcaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagaacuggauccugcgccacccgggcuucaccaucauggccgcgauccuggccuacaccaucgggaccacccacuuccagcgggcccucaucuucauccugcugacggccguggcgcccagcaugaccaugcgcugcaucggcaucuccaaccgggacuucgucgagggcgugagcgggggcuccuggguggacaucguccucgagcacgggagcugcgugaccaccauggccaagaacaagcccacgcuggacuucgagcugaucaagaccgaggccaagcagcccgccacccuccgcaaguacugcaucgaggccaagcugaccaacacgaccaccgagucccggugcccgacccagggcgagcccagccugaacgaggagcaggacaagcgcuucaucugcaagcacuccaugguggaccggggcugggggaacggcugcgggcuguucggcaagggcgggaucgucacgugcgcgauguucacgugcaagaagaacauggagggcaagguggugcagcccgagaaccuggaguacaccaucgucaucacgccccacagcggggaggagcacgccgugggcaacgacacggggaagcacggcaaggagaucaagaucaccccgcaguccagcaucaccgaggccgagcugaccggguacggcaccgugacgauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacccuggugacguucaagaacccccacgcgaagaagcaggacgucgugguccucgggucccaggagggcgccaugcacaccgcccugaccggggccaccgagauccagaugagcagcggcaaccuccuguucacgggccaccugaagugccgccugcggauggacaagcuccagcugaaggggauguccuacagcaugugcaccggcaaguucaagaucgugaaggagaucgccgagacccagcacgggaccaucgugauccgcguccaguacgagggcgacggcucccccugcaagauccccuucgagaucacggaccuggagaagcggcacgugcucgggcgccugaucaccgugaacccgaucgucaucgagaaggacagccccgugaacaucgaggcggagccgcccuucggcgacuccuacgugaucaucggggucgagccgggccagcugaagcucaacugguucaagaaggggagcuccaucggccagauguucgagaccaccaugcgcggcgccaagcggauggccauccugggggacacggccugggacuucggcagccucggcgggguguucaccuccaucgggaaggcccuccaccagguguucggggcgaucuacggcgccgccuucagcggggucuccuggaccaugaagauccugaucggcguggugaucaccuggaucgggaugaacagccgcuccacgagccuguccgucagccuggugcucgugggcgucgugacccuguaccugggggccauggugcaggcggacuccggcugcgucgugagcuggaagaacaaggagcucaagugcggcuccgggaucuucaucaccgacaacgugcacaccuggacggagcaguacaaguuccagcccgagagccccagcaagcuggccuccgccauccagaaggcccacgaggagggcaucugcgggauccggagcgucacccgccuggagaaccucauguggaagcagaucacccccgagcugaaccacauccuguccgagaacgaggugaagcucaccaucaugacgggcgacaccaaggggaucaugcaggccggcaagcggagccugcgcccgcagcccaccgagcugaaguacuccuggaagaccuggggcaaggcgaagaugcucagcacggagucccacaaccagaccuuccugaucgacgggcccgagaccgccgagugcccgaacaccaaccgggccuggaacagccuggagguggaggacuacggcuucggggucuucacgaccaacaucuggcucaagcugcgcgagaagcaggacguguucugcgacuccaagcugaugagcgccgccaucaaggacaaccgggcggugcacgccgacaugggcuacuggaucgaguccgcccucaacgacaccuggaagauggagaaggccagcuucaucgaggucaaguccugccacuggcccaagagccacacccugugguccaacggcgugcuggagagcgagaugaucauccccaagaacuucgccgggcccgugucccagcacaacuaccgcccgggcuaccacacccagacggcggggcccuggcaccucggcaagcuggagauggacuucgacuucugcgaggggaccaccgucguggugaccgaggacugcggcaaccggggccccagccugcgcacgaccaccgccagcgggaagcucaucaccgaguggugcugccgguccugcacgcugcccccgcugcgcuaccggggcgaggacgggugcugguacggcauggagauccgcccccucaaggagaaggaggagaaccuggucaacagccuggugaccgccgggcacggccagaucgacaacuucucccucggcgugcuggggauggcccuguuccucgaggagaugcugcggacccgcgucggcaccaagcacgcgauccugcucguggccgugagcuucgucacgcugaucaccgggaacauguccuuccgggaccugggccgcgugauggugauggucggggccaccaugaccgacgacaucggcaugggcgugacguaccucgcccugcuggccgcguucaaggugcgccccaccuucgccgccgggcuccugcugcggaagcucaccagcaaggagcugaugauggccaccaucggcaucacgcugcucucccagagcaccauccccgagaccauccuggagcugaccgacgcccucgcgcuggggaugaugguccugaagaucgugcgcaacauggagaaguaccagcucgccgugacgaucauggccaucuccugcgucccgaacgccgugauccugcggaacgccuggaaggucagcugcaccauccuggcggccguguccgugagcccccuccugcugaccuccagccagcagaaggccgacuggaucccccucgcccugaccaucaagggccugaaccccacggcgaucuuccucaccacccugucccgcaccagcaagaagcgguccuggccgcugaacgaggccaucauggccgucggcauggugagcauccucgccuccagccugcugaagaacgacauccccaugacggggccccucguggccggcgggcugcugaccgucugcuacgugcucaccggccgcagcgcggaccuggagcuggagcgggccgccgacgugaagugggaggaccaggccgagaucuccgggagcucccccauccucagcaucaccaucuccgaggacggcagcauguccaucaagaacgaggaggaggagcagacgcugaccauccugauccgcaccggccuccuggucaucagcgggguguucccgguguccauccccaucaccgccgcggccugguaccugugggaggucaagaagcagcgggccggcgugcucugggacgugcccagcccgccgcccgucgggaaggccgagcuggaggacggcgccuaccgcaucaagcagcgggggauccugggcuacucccagaucggcgcggggguguacaaggagggcaccuuccacacgauguggcacgugacccgcggggccguccucaugcaccggggcaagcgcaucgagcccagcugggccgacgugaagaaggaccugaucuccuacgggggcggcuggaagcuggagggggaguggaaggagggcgaggaggugcagguccucgcccuggagcccgggaagaacccccgggccgugcagaccaagcccggcaucuucaagaccaacacggggaccaucggcgcggugagccuggacuucucccccggcaccagcgggucccccaucgucgaccgcaagggcaaggugguggggcucuacggcaacggcgucgugacccggagcggggccuacguguccgccaucgcccagacggagaaguccaucgaggacaaccccgagaucgaggacgacaucuuccgcaagaagcggcugaccaucauggaccugcaccccggcgcggggaagaccaagcgcuaccuccccgccaucguccgggaggccaucaagcgcggccugcgcacccugauccuggccccgacgcgggugguggccgcggagauggaggaggcccuccgcgggcugcccauccgguaccagacccccgccaucaaggccgagcacaccggccgcgagaucgucgaccugaugugccacgccaccuucacgaugcggcuccugagccccgugcgcgugccgaacuacaaccugaucaucauggacgaggcgcacuucaccgaccccgccuccaucgccgcccggggcuacaucagcacccgcgucgagaugggggaggccgcgggcaucuucaugaccgccacgccgcccgggucccgggacccguucccccagagcaacgcccccaucauggacgaggagcgcgagauccccgagcgguccuggaacagcggccacgagugggugaccgacuucaaggggaagaccgugugguucgucccguccaucaaggccggcaacgacaucgcggccugccuccgcaagaacggcaagaaggugauccagcugagccggaagaccuucgacuccgaguacgugaagacgcgcgccaacgacugggacuucgucgugaccaccgacaucagcgagaugggggccaacuucaaggccgagcgggugaucgacccccgccggugcaugaagcccgucauccugaccgacggcgaggagcgcgugauccucgcggggcccaugccggugacgcacuccagcgccgcccagcggcgcggccgcaucgggcggaaccccaagaacgagaacgaccaguacaucuacaugggcgagccccuggagaacgacgaggacugcgcccacuggaaggaggccaagaugcugcucgacaacaucaacacccccgagggcaucaucccguccauguucgagcccgagcgcgagaaggucgacgcgaucgacggggaguaccggcugcgcggcgaggcccggaagaccuucguggaccugaugcgccgcggggaccuccccguguggcuggccuacaaggucgccgccgagggcaucaacuacgcggaccgcaaguggugcuucgacgggaucaagaacaaccagauccuggaggagaacguggaggucgagaucuggaccaaggagggcgagcggaagaagcucaagccgcgcuggcuggacgcccggaucuacagcgacccccuggcccucaaggaguucaaggaguucgccgcgggccgcaagucccugacgcugaaccucaucaccgagauggggcggcugcccaccuucaugacccagaaggcccgcaacgcccuggacaaccucgccgugcugcacacggccgaggcgggcgggcgggccuacaaccacgcccugagcgagcuccccgagacccuggagacccugcuccugcugacccuccuggccacggugaccggcggcaucuuccuguuccucauguccgggaagggcaucgggaagaugacccugggcaugugcugcaucaucaccgccagcguccugcucugguacgcgcagauccagccgcacuggaucgccgccuccaucauccuggaguucuuccugaucgugcuccugauccccgagcccgagaagcagcgcacgccccaggacaaccagcugacguacguggucaucgccauccucaccgugguggccgcgaccauggccaacgagaugggguuccuggagaagaccaagaaggaccugggccucggcagcaucacgacccaggagagcgaguccaacauccuggacaucgaccugcggccggccagcgccuggacccucuacgccgucgcgaccacguucgugacccccaugcugcgccacuccaucgagaacagcuccgugaacgucagccugaccgccaucgccaaccaggccaccgugcucauggggcugggcaagggguggccccuguccaagauggacaucggcgugccccuccuggcgaucgggugcuacagccaggucaacccgaucacgcugaccgccgcccuccugcugcucguggcccacuacgccaucaucggccccggccugcaggcgaaggccacccgggaggcccagaagcgcgccgccgcggggaucaugaagaaccccaccguggacggcaucacggucaucgaccuggagcccaucccguacgaccccaaguucgagaagcagcucggccaggugaugcugcugauccucugcgugacccagguccugaugaugcggaccaccugggcccugugcgaggcccucacgcuggccaccggccccaucuccacccugugggaggggaaccccggccgcuucuggaacaccacgaucgccgugagcauggcgaacaucuuccgcggcuccuaccucgccggggccggccugcuguucagcaucaugaagaacaccaccaacacccggcgcgggacgggcaacaucggcgagacccucggggagaaguggaagucccggcugaacgcccugggcaagagcgaguuccagaucuacaagaaguccgggauccaggagguggaccgcacccucgcgaaggagggcaucaagcgcggggagaccgaccaccacgccgucagccgcggcuccgccaagcugcggugguucguggagcgcaacauggugacgccggagggcaaggucguggaccuggggugcggccgcggcggguggagcuacuacugcggcgggcucaagaacgugcgcgaggucaaggggcugaccaagggcgggcccgggcacgaggagcccauccccauguccaccuacggcuggaaccuggugcggcuccagagcgggguggacgucuucuucaccccgcccgagaagugcgacacgcugcugugcgacaucggcgagagcucccccagccccaccaucgaggccggccgcacccuccgggugcugaaccugguggaggacuggcucaacaacaacacccaguucugcaucaagguccugaacccguacaugcccuccgugaucgagaagauggagacccugcagcgcaaguacgggggcgcccucgugcggaacccccugagccgcaacuccacgcacgagauguacugggucagcaacgcgaccgggaacaucguguccagcgugaacaugaucucccggaugcugaucaaccgcuucaccaugaagcacaagaaggccaccuacgagccggacgucgaccugggcagcgggacgcggaacaucggcaucgaguccgagauccccaaccucgacaucaucggcaagcgcaucgagaagaucaagcaggagcacgagaccagcuggcacuacgaccaggaccacaccuacaagaccugggccuaccacggguccuacgagacgaagcagaccggcagcgccuccagcauggugaacggggugguccgccugcugaccaagcccugggacguggugcccauggucacccagauggccaugacggacaccaccccguucggccagcagcggguguucaaggagaagguggacacccgcacgcaggagcccaaggagggcaccaagaagcucaugcggaucaccgcggaguggcuguggaaggagcuggggaagaagaagacgccccggaugugcacgcgggaggaguucacccgcaagguccgguccaacgccgcccucggcgccaucuucaccgacgagaacaaguggaaguccgcccgcgaggcgguggaggacgggcgguucugggagcuggucgaccgcgagcggaaccugcaccucgagggcaagugcgagaccugcguguacaacaugauggggaagcgcgagaagaagcugggcgaguucggcaaggccaaggggucccgggccaucugguacauguggcugggcgcccgcuuccucgaguucgaggcgcugggguuccugaacgaggaccacugguucagccggggcaacagccucuccgggguggagggcgagggccugcaccgccugggguacauccuccgggacgucggcaagaaggagggcggcgccauguacgccgacgacacggccgggugggacacccgcaucacccuggaggaccugaagaacgaggagauggugaccaaccacaugaagggcgagcacaagaagcucgccgaggcgaucuucaagcugacguaccagaacaaggugguccgggugcagcgccccaccccgcggggcaccgugauggacaucaucagccgccgcgaccagcggggguccggccaggucgggaccuacggccugaacacguucaccaacauggaggcccagcucauccgccagauggagggcgaggggaucuucaagagcauccagcaccugaccgccaccgaggagaucgccgugcagaacuggcuggcccgggugggccgcgagcggcucucccgcauggcgaucagcggggacgacugcgucgugaagcccaucgacgaccgguucgccuccgcccugacggcccugaacgacaugggcaaggugcgcaaggacauccagcagugggagcccagccggggguggaacgacuggacccagguccccuucugcucccaccacuuccacgagcucgugaugaaggacggccgcgugcuggucgugccgugccggaaccaggacgagcugaucggccgcgcccggaucagccagggggcgggcuggucccucaaggagaccgccugccugggcaagagcuacgcccagauguggacccugauguacuuccaccgccgggaccuccgccuggccgccaacgcgaucugcuccgccgugcccagccacuggguccccaccucccggacgaccuggagcauccacgccaagcacgaguggaugaccaccgaggacaugcuggccguguggaaccgcguguggauccaggagaaccccuggauggaggacaagacgccggucgaguccugggaggaggugcccuaccucggcaagcgggaggaccaguggugcgggagccugaucggccugaccagccgcgcgaccugggccaagaacauccagaccgccaucaaccaggugcgcucccucaucggcaacgaggaguacacggacuacaugcccagcaugaagcgguuccgccgggaggaggaggaggccgggguccugugguga

SEQ ID NO: 9775 - RNA, 9876 nt, Artificial Sequence
  derived and/or modified CDS sequence (opt1) from DENV-2__JN368476__SS-prME
agcgccggcaugaucaucaugcugauccccaccgugauggccuuccaccucaccacccgcaacggggagccccacaugaucgugggcauccaggagaagggcaagagccugcuguucaagaccgaggacggcgugaacaugugcacccucauggcgauggaccugggggagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcagcgucgcccuggugccccacguggggaugggccucgagacccggaccgagaccuggauguccagcgagggggccuggaagcacgcccagcgcaucgagaccuggauccugcggcacccgggcuucacgaucauggccgcgauccuggccuacaccaucgggaccacccacuuccagcgcgcccucaucuucauccugcugacggccgucgcgcccuccaugaccaugcggugcaucggcaucagcaaccgcgacuucguggagggcguguccgggggcagcugggucgacaucgugcucgagcacggguccugcgugaccaccauggccaagaacaagcccacgcuggacuucgagcugaucaagaccgaggccaagcagcccgccacccuccggaaguacugcaucgaggccaagcugaccaacacgaccaccgagagccgcugccccacccagggcgagcccucccugaaggaggagcaggacaagcgguucgucugcaagcacagcaugguggaccgcggcugggggaacggcugcgggcuguucggcaagggcgggaucgugacgugcgcgauguucacgugcaagaagaacauggagggcaagaucguccagcccgagaaccuggaguacaccaucguggugacgccccacuccggggaggagcacgccgucggcaacgacacggggaagcacggcaaggagaucaaggugaccccgcagagcuccaucaccgaggccgagcugaccggguacggcaccgugacgauggagugcagcccccggaccggccucgacuucaacgagaugguccugcugcagauggaguccaaggccuggcucgugcaccgccagugguuccuggaccugccccuccccuggcugccgggggccgacaagcagggcagcaacuggauccagaaggagacccuggugaccuucaagaacccccacgcgaagaagcaggacgucgugguccucgggagccaggagggcgccaugcacacggcccugaccggggccaccgagauccagauguccagcggcaaccuccuguucaccggccaccugaagugccggcugcgcauggacaagcuccagcugaaggggauguccuacagcaugugcacgggcaaguucaagguggugaaggagaucgccgagacccagcacgggaccaucgucauccgggugcaguacgagggcgacggcucccccugcaagauccccuucgagaucauggaccuggagaagcgcuacgugcucgggcggcugaucaccgucaacccgaucgugacggagaaggacagccccgugaacaucgaggcggagccgcccuucggcgacuccuacaucaucaucggggucgagccgggccagcugaagcucaacugguucaagaaggggagcuccaucggccagauguucgagaccaccaugcgcggcgccaagcgcauggccauccugggggacaccgccugggacuucggcagccucggcgggguguucacguccaucgggaaggcccuccaccagguguucggggcgaucuacggcgccgccuucagcggggucuccuggaccaugaagauccugaucggcgugaucaucaccuggaucgggaugaacagccgguccaccagccuguccgugagccugguccucgugggcaucgugacgcuguaccugggggucauggugcaggccgacuccggcugcguggucagcuggaagaacaaggagcucaagugcggcagcgggaucuucaucaccgacaacgugcacaccuggaccgagcaguacaaguuccagcccgagucccccagcaagcuggcguccgccauccagaaggcccaggaggagggcaucugcgggauccgcagcgugacgcggcuggagaaccucauguggaagcagaucacccccgagcugaaccacauccuggccgagaacgaggucaagcucaccaucaugaccggcgacaucaaggggaucaugcaggccggcaagcgcucccugcggccgcagcccacggagcugaaguacagcuggaagaccuggggcaaggcgaagaugcucuccaccgagagccacaaccagaccuuccugaucgacgggcccgagacggccgagugcccgaacaccaaccgcgccuggaacucccuggagguggaggacuacggcuucgggguguucaccaccaacaucuggcucaagcugaaggagaagcaggacgccuucugcgacagcaagcugauguccgccgcgaucaaggacaaccgggccguccacgccgacaugggcuacuggaucgagagcgcccucaacgacacguggaagaucgagaaggccuccuucaucgaggugaagaacugccacuggcccaagagccacacccugugguccaacggcgugcuggagagcgagaugaucauccccaagaaccucgcggggcccgucucccagcacaacuaccgcccgggcuaccacacccagaccgccgggcccuggcaccugggcaagcuggagauggacuucgacuucugcgacgggaccacggugaucgugaccgaggacugcggcaaccggggccccagccuccgcaccaccacggccagcgggaagcugaucaccgaguggugcugccgguccugcacccugcccccgcuccgcuaccggggcgaggacgggugcugguacggcauggagauccgcccccugaaggagaaggaggagaaccuggucaacagccucgugaccgccgggcacggccagguggacaacuucucccugggcguccuggggauggcccuguuccuggaggagaugcugcggacgcgcgugggcaccaagcacgccauccuccugguggccgucagcuucgugacccugaucaccgggaacauguccuucaaggaccucggccggguggucgugaugguggggacgaccaugaccgacgacaucggcaugggcgucaccuaccuggcccugcucgccgcguucaaggugcgccccacguucgccgccgggcugcugcuccggaagcugaccagcaaggagcugaugaugaccaccaucggcaucgugcuccugucccagagcacgauccccgagaccauccuggagcucaccgacgcccuggcccuggggaugaugguccucaagaucgugcgcgacauggagaaguaccagcuggcggugaccaucauggccauccugugcgucccgaacgccgugauccuccagaacgccuggaaggucuccugcacgauccuggccguggugagcgucagcccccugcuccugaccagcucccagcagaagaccgacuggaucccccuggcgcucaccaucaagggccugaaccccacggccaucuuccugaccacccucagccgcaccaacaagaagcgguccuggccgcugaacgaggccaucauggccgugggcauggugagcauccuggcguccagccuccugaagaacgacauccccaugacggggccccuggucgccggcgggcuccugaccgugugcuacgugcugaccggccgcuccgccgaccucgagcuggagcgggccaccgacgucaagugggaggaccaggccgagaucagcgggagcucccccauccugagcaucacgaucuccgaggacggcagcauguccaucaagaacgaggaggaggagcagacccucaccauccugauccgcaccggccugcucgugaucagcgggcuguucccgguguccauccccaucaccgcggccgccugguaccugugggaggucaagaagcagcgggccggcgugcucugggacgugcccuccccgccgcccauggggaaggccgagcuggaggacggcgcguaccgcaucaagcagaaggggauccugggcuacucccagaucggcgccggggucuacaaggagggcacguuccacaccauguggcacgugacccgcggggcggugcucaugcacaagggcaagcgcaucgagcccagcugggccgacgucaagaaggaccugaucuccuacgggggcggcuggaagcuggagggggaguggaaggagggcgaggagguccaggugcucgcccuggagcccgggaagaacccccgggcgguccagaccaagcccggccuguucaagacgaacaccgggaccaucggcgccgugagccucgacuucucccccggcaccagcgggucccccaucaucgacaagaagggcaagguggucgggcuguacggcaacggcguggugacgcgcagcggggccuacgucuccgccaucgcccagaccgagaaguccaucgaggacaaccccgagaucgaggacgacaucuuccggaagcgccggcugaccaucauggaccugcaccccggcgcggggaagaccaagcgcuaccuccccgccaucgugcgggaggccaucaagcgcggccugcggacgcugauccucgccccgacccgcguggucgcggccgagauggaggaggcccugcgggggcugcccauccgcuaccagacccccgccauccgggccgagcacaccggccgcgagaucguggaccucaugugccacgcgacguucaccaugcgccugcugucccccgugcgggucccgaacuacaaccucaucaucauggacgaggcccacuucaccgaccccgccagcaucgccgcccgcggcuacaucagcacccggguggagaugggggaggcggccggcaucuucaugacggccacgccgcccgggucccgcgacccguucccccagagcaacgcccccaucaucgacgaggagcgggagauccccgagcgcuccuggaacaccggccacgagugggugaccgacuucaaggggaagacggucugguucgugccgagcaucaaggccggcaacgacaucgcggccugccugcggaagaacggcaagaaggugauccagcugucccgcaagaccuucgacagcgaguacgucaagacccggaccaacgacugggacuucguggugacgaccgacaucuccgagaugggggccaacuucaaggccgagcgcgucaucgacccccggcgcugcaugaagcccgugauccucaccgacggcgaggagcgggugauccuggcggggcccaugccggucacccacagcuccgccgcccagcgccggggccgcaucgggcggaaccccaagaacgagaacgaccaguacaucuacaugggcgagccccuggagaacgacgaggacugcgcccacuggaaggaggccaagaugcuccuggacaacaucaacacgcccgagggcaucaucccgagcauguucgagcccgagcgcgagaagguggacgcgaucgacggggaguaccggcugcgcggcgaggcccgcaagaccuucguggaccucaugcggcgcggggaccugcccgucuggcuggccuacaagguggccgccgagggcaucaacuacgcggaccggcgcuggugcuucgacgggaucaagaacaaccagauccucgaggagaacguggaggucgagaucuggaccaaggagggcgagcggaagaagcugaagccgcgcuggcuggacgcccggaucuacuccgacccccucgcccugaaggaguucaaggaguucgccgccggccgcaagagccugacccucaaccugaucacggagauggggcggcugcccaccuucaugacccagaagacccgcgacgcgcucgacaaccuggccgugcugcacacggccgaggccggcgggcgggcguacaaccacgcccucuccgagcugcccgagacccuggagacccuccugcugcucacccugcuggccaccgucacgggcggcaucuuccucuuccugaugagcgggcgcggcaucgggaagaugacccugggcaugugcugcaucaucaccgccuccgugcuccugugguacgcccagauccagccgcacuggaucgcggccagcaucauccuggaguucuuccucaucgugcugcugauccccgagcccgagaagcagcggacgccccaggacaaccagcucacguacgucgugaucgccauccugaccguggucgccgccaccauggcgaacgagaugggguuccuggagaagaccaagaaggaccucggccugggcuccaucgccacgcagcagccggagagcaacauccuggacaucgaccuccgccccgccuccgccuggacccuguacgccguggcgaccaccuucgugacgcccaugcugcggcacagcaucgagaacagcuccgucaacgugagccucaccgccaucgccaaccaggccaccgugcugauggggcugggcaagggguggccccucuccaagauggacaucggcgucccgcugcuggccaucgggugcuacagccaggugaaccccaucacccucacggcggcccugcugcuccugguggcccacuacgccaucaucggccccggccugcaggcgaaggccacccgcgaggcccagaagcgggccgccgcggggaucaugaagaaccccaccgucgacggcaucaccgugaucgaccucgacccgauccccuacgaccccaaguucgagaagcagcugggccaggugaugcugcucauccugugcgucacccaggugcugaugaugcgcaccaccugggcccucugcgaggcccugacccuggccacgggccccaucuccacccucugggaggggaacccgggccgguucuggaacaccaccaucgccgugagcauggcgaacaucuuccgcggcuccuaccuggccggggccggccuccucuucagcaucaugaagaacacgaccaacacccggcgcgggaccggcaacaucggcgagacgcugggggagaaguggaagucccgccugaacgcccucggcaagagcgaguuccagaccuacaagaaguccgggauccaggaggucgaccggacccuggccaaggagggcaucaagcgcggggagaccgaccaccacgcggugagccggggcuccgccaagcugcgcugguucguggagcggaacauggucacgcccgagggcaaggugguggaccucgggugcggccgcgggggcuggagcuacuacugcgggggccugaagaacguccgggaggugaagggccugaccaagggcgggcccgggcacgaggagcccaucccgauguccaccuacggcuggaaccucgugcgccugcagagcggggucgacguguucuucaucccgcccgagaagugcgacacccugcucugcgacaucggcgaguccagccccaacccgaccguggaggccggccggacgcugcgcguccugaaccucguggagaacuggcugaacaacaacacccaguucugcaucaaggugcugaaccccuacaugcccuccgucaucgagaagauggaggcccugcagcggaaguacgggggcgcgcucgugcgcaacccgcugagccggaacagcacccacgagauguacuggguguccaacgccagcgggaacaucgucuccagcgugaacaugaucucccgcaugcugaucaaccgguucaccaugcgccacaagaaggccacguacgagcccgacguggaccucggcagcgggacccggaacaucggcaucgaguccgagauccccaaccuggacaucaucggcaagcgcaucgagaagaucaaggaggagcacgagaccagcuggcacuacgaccaggaccaccccuacaagaccugggccuaccacggguccuacgagacgaagcagaccggcagcgccuccagcauggucaacgggguggugcggcugcucaccaagccgugggacguccugcccaccgugacgcagauggcgaugaccgacaccacccccuucggccagcagcgcguguucaaggagaaggucgacacgcgcacccaggagcccaaggagggcaccaagaagcugaugaagaucaccgccgaguggcucuggaaggagcuggggaagaagaagacgccgcggaugugcacccgcgaggaguucacccggaaggugcgcuccaacgccgcccugggcgccaucuucaccgacgagaacaaguggaaguccgcgcgggaggccguggaggacucccgcuucugggagcucgucgacaaggagcggaaccugcaccuggaggggaagugcgagacgugcguguacaacaugaugggcaagcgcgagaagaagcucggggaguucggcaaggccaagggcagccgggccaucugguacauguggcugggggcccgcuuccuggaguucgaggcgcucggcuuccugaacgaggaccacugguucucccgggagaacagccuguccggggucgagggcgaggggcuccacaagcugggcuacauccugcgcgacgugagcaagaaggagggcggggccauguacgccgacgacaccgccggcugggacacccggaucacccucgaggaccugaagaacgaggagauggugacgaaccacauggagggggagcacaagaagcuggcggaggccaucuucaagcucaccuaccagaacaaggucgugcgcgugcagcggcccacgccccggggcaccgucauggacaucaucagccggcgcgaccagcggggguccggccaggugggcacguacgggcugaacaccuucaccaacauggaggcccagcugauccgccagauggagggcgaggggguguucaagaacauccagcaccucaccgucacggaggaggccgccgugcagaacuggcuggcgcgggugggccgcgagcgccugagccggauggccaucuccggcgacgacugcgucgugaagccccucgacgaccgcuucgccaacgcccugaccgcccugaacgacauggggaagauccggaaggacauccagcagugggagccgagcaagggcuggaacgacuggacccaggugcccuucugcucccaccacuuccacgagcucaucaugaaggacgggcgcguccugguggugcccugccggaaccaggacgagcugaucggccgcgcgcggaucagccagggggccggcuggucccuccgcgagaccgccugccugggcaagagcuacgcccagauguggucccugauguacuuccaccggcgcgaccuccggcuggccgcgaacgccaucugcagcgccguccccucccacugggugccgaccagccgcacgaccugguccauccacgccaagcacgaguggaugaccaccgaggacaugcugacgguguggaaccgggucuggauccgcgagaaccccuggauggaggacaagacccccguggagagcugggaggagauccccuaccucgggaagcgggaggaccaguggugcggcucccugaucgggcugaccagccgcgccaccugggcgaagaacauccaggccgccaucaaccaggugcggucccucaucggcaacgaggaguacacggacuacaugccgagcaugaagcgcuuccggcgcgaggaggaggaggccgggguccugugguga

SEQ ID NO: 9776 - RNA, 9876 nt, Artificial Sequence
  derived and/or modified CDS sequence (opt1) from DENV-2__JF260983__SS-prME
accgccggguuccugaucauggugauccccaccgucauggccuuccaccucaccacccggaacggggagccccacaugaucgugagcaagaacgagaagggcaaggggcugcuguucaagaccgagaacggcaucaacaugugcacccucauggcgauggaccugggggagcugugcgaggacacggugaccuacaagugccccuuccucaagcagaacgagcccgaggacaucgacugcuggugcaacuccaccagcaccugggucacguacgggaccugcuccagcaccggcgagcaccggcgggagaagcgguccguggcccuggugccccacgucgggaugggccuggagacccggacggagaccuggaugagcuccgagggggccuggaagcaggcccagcggaucgagaccuggauccuccgccaccccggcuucacccugauggccgcggugcuggccuacacgaucgggaccacccacuuccagcgggcccucaucuucauccugcugaccgccguggcgcccagcaugacgaugcgcugcaucggcaucuccaaccgggacuucgucgagggcgugagcgggggcuccuggguggacaucguccucgagcacgggagcugcgugaccaccauggccaagaacaagcccacccuggacuucgagcugaucaagacggaggccaagcagcccgccacccuccgcaaguucugcaucgaggccaagcugaccaacaccacgaccgagucccggugcccgacccagggcgagcccagccugguggaggagcaggacaagcgcuucgucugccggcacuccaugguggaccgcggcugggggaacggcugcggccucuucggcaagggcgggaucgugaccugcgcgauguucacgugccugaagaagauggagggcaaggucgugcagcccgagaaccuggaguacaccaucgugaucacgccccacagcggggaggagcacgccgucggcaacgacaccgggaagcacggcaaggaggugaagaucacgccgcaguccagcaucuccgagaccgagcucaccgacuacgggaccaucaccauggagugcagcccccggacgggccuggacuucaacgagauggugcugcuccagauggagagcaaggccuggcugguccaccgccagugguuccuggaccucccccugcccuggcugccgggcgccgacacccagggguccaacuggauccagaaggagaugcucgugaccuucaagaacccccacgccaagcggcaggacgucguggugcugggcagccaggagggggcgaugcacaccgcccugacgggcgccaccgagauccagaugucccucgggaacauccuguucaugggccaccugaagugccgccuccggauggacaagcugcagcugaagggcaugagcuacuccaugugcaccgggaaguucaaggucgugaaggagaucgccgagacccagcacggcacgaucgugauccgcguccaguacgagggggacgacagccccugcaagauccccuucgagaucauggaccucgagaagaagcacgugcugggccggcugaucaccgugaacccgaucgucaccgagaaggacucccccaucaacaucgaggccgagccgcccuucggcgacagcuacaucgugaucgggguggagccgggccagcucaagcugaacugguucaagaagggguccagcaucggccagauguucgagaccacgaugcgcggggcgaagcgcauggccauccugggcgacaccgccugggacuucggcuccaucgggggcgucuucaccagcguggggaaggcccuccaccagguguucggcgccaucuacggggcggccuucuccggcgucagcuggaccaugaagauccugaucggcguggugaucacguggaucgggaugaacucccggagcaccucccugagcgucacccuggugcucgugggcaucgucacccuguaccugggggugauggugcaggccgacuccggcugcgucgugagcuggaagaacaaggagcucaagugcgggagcggcaucuucgugacggacaacguccacaccuggaccgagcaguacaaguuccagcccgacucccccagcaagcuggccuccgcgauccagaaggcccacgaggagggcaucugcgggauccgcagcgugacccggcuggagaaccucauguggaagcagaucacgcccgagcugaaccacauccuguccgagaacgaggugaagcucaccaucaugaccggcgagaucaaggggaucaugcaggccggccgccggagccugaagccgcagcccaccgagcugcgcuacuccuggaagacgugggggaaggccaagguccucagcaccgagcugcagaaccagaccuuccugaucgacggccccgagaccacggagugcccgaacuccaaccgggccuggaacagccucgagguggaggacuacggcuucgggaucuucaccaccaacaucuggcugaagcugcgcgagaagcaggacaugaucugcgacuccaagcucaugagcgcggccgugaaggacgaccgggccguccacgccgacaugggcuacuggaucgagucccgccugaacgacaccuggaagauggagaaggccagcuucaucgaggugaaguccugcuacuggccccggagccacacgcugugguccaacggggugcucgagagcgagaugaucauccccaagaaccuggcgggccccgucagccagcacaacuaccgcccgggcuacuacacccagaccgccgggcccuggcaccugggcaagcucgagauggacuucgaguucugcgaggggaccaccgugguggucacggaggacugcggcaaccgggggcccucccugcgcaccaccaccgccagcggcaagcugaucacggaguggugcugccgguccugcacccucccgccccugcgcuaccggggcgaggacgggugcugguacggcauggagauccgcccccugaaggagcgggaggagaaccucgugaacagccuggugaccgccgggcacggccagaucgacaacuucucccuggggauccucggcauggcccugcugcucgaggagaugcugcgcacccgcgucggcacgaagcacgcgcugcuccugguggccaucagcuucgugacccugaucaccgggaacauguccuucaaggaccucggccgggucaucaucauggugggggccgccaugaccgacgagaugggcaugggggugacguaccuggcgcugcucgccgccuuccgcguccggcccaccuucgccgugggccugcugcuccgcaagcugaccagcaaggagcugcucauggccaccaucggcgugguccugcugucccagagcaacauccccgggacggugcucgagcugaccgacgcgaucgcccugggcaucaugguccucaagaucaugcgguccauggagaaguaccagcuggccgugaccgugauggccaugcugugcauccccaacgucaugauccuccagcacgccuggaagguggggugcaccauccuggcggccgugagcgucagcccccugcuccugacgagcucccagcagaagaccgacuggaucccccuggcccucaccaucaagggccugaaccccaccgccaucuuccugacgacccucagccgcccguccaagauccggagcuggccccugaacgaggccaucauggcggugggcaugguguccauccuggccagcagccuccugaagaacgacauccccaugaccgggccccuggucgccggcgggcuccugaccgugugcuacgugcugacgggccgcuccgccgaccucgagcuggagaaggcggccgaggucaagugggaggaccaggccgagaucagcggguccagcccgauccuguccaucaccaucagcgaggacggcuccaugagcaucaagaacgaggaggaggagcagacccucaccauccugauccggacgggccugcucgugaucuccgggcuguuccccgugagcauccccaucaccgccgccgcgugguaccugugggagaccaagaagcagcgcgccggcguccucugggacgugcccuccccgccgcccauggggaaggccgagcuggaggacggcgccuaccggaucaagcagcgcgggaucuucggcuacagccagaucggcgccgggguguacaaggagggcaccuuccacacgauguggcacgucacccgcggggcggugcuggugcacaagggcaagcgccucgagccguccugggccgacgucaagaaggaccugaucagcuacgggggcggcuggaagcuggagggggaguggaaggacggcgaggagguccaggugcucgcccuggagcccgggaagaacccccgggccguccagaccaagcccggccuguucaagaccaacaccgggacgaucggcgccgugucccuggacuucagcccgggcaccuccgggagccccaucaucgaccgcaagggcaagguggucgggcucuacggcaacggcguggugacccgguccgggaccuacgucagcagcaucgcgcagacggagaaguccguggaggacaaccccgagaucgaggacgacaucuuccgcaagaagcggcugaccaucauggaccugcaccccggcgccgggaagaccaagcgcuaccucccggccaucgugcgggaggccauccgccgcggccugcggacccugauccucgcccccacgcgcgucguggcggccgagauggaggaggcccugcgggggcugcccauccgcuaccagacccccgccaucaaggcggagcacaccggccgggagaucguggaccucaugugccacgccaccuucacgaugcgccugcugagcccgauccggguccccaacuacaaccucaucaucauggacgaggcccacuucaccgaccccgccuccaucgccgcgcgcggcuacaucagcacccggguggagaugggggaggccgccggcaucuucaugaccgccacgcccccggggucccgcgaccccuucccccagagcaacgcccccaucauggacgaggagcgggagaucccggagcgcuccuggaacagcggccacgaguggaucaccaacuucaaggggaagaccgugugguucguccccuccauccgggcgggcaacgacaucgccgccugccugcgcaagaacggcaagcgggugauccagcugagccgcaagaccuucgacacggaguacaccaagacccggaccaacgacugggacuucguggucacgaccgacaucuccgagaugggggccaacuucaaggccgagcgcgugaucgacccccggcgcugcaugaagcccgugauccucaccgacggcgaggagcgcgucgugcuggcggggccgaugcccgugacccacagcuccgccgcccagcggcgcggccggaucgggcgcaaccccaagaacgagaacgaccaguacaucuacaugggcgagccccuggagaacgacgaggacugcgcccacuggaaggaggcgaagaugcuccuggacaacaucaacacgccggagggcaucauccccagcauguucgagcccgagcgggagaaggucgacgccaucgacggggaguaccgccugcggggcgaggcccgcaagaccuucguggaccucaugaagcgcggggaccugccgguguggcuggccuacaaggucgccuccgagggcaucaacuacgcggaccgcaaguggugcuucgacgggauccggaacaaccagauccucgaggagaacaucgagguggaggucuggaccaaggagggcgagcgcaagaagcugaagccccgguggcuggacgcccgcaccuacagcgacccccucgcccugaaggaguucaaggaguucgccgccggccggaagucccugacgcucagccugaucaccgagauggggcgccugcccaccuucaugacccagaagacgcgggacgcgcucgacaaccuggccgugcugcacuccgccgagaugggcgggcgcgccuacaaccacgcccucagcgagcugccggagacccuggagacccuccugcugcucggccugcuggcgaccgugacgggcgggaucuuccucuuccugaugagcggccgcggggugggcaagaugacccuggggaugugcugcaucaucaccgccuccggccuccugugguacgcccagauccagccccacuggaucgccgcgagcaucauccuggaguucuuccucaucgugcugcugauccccgagcccgagaagcagcgcaccccgcaggacaaccagcucaccuacguggucaucgccauccugacgcugguggccgccaccauggccaacgagaugggcuuccucgagaagaccaagaaggaccuggggcugggcggguucaccaugcagcagcccgagaucaacauccucgacaucgaccugcggcccgcguccgccuggacgcuguacgccguggccaccaccuucgucacccccaugcuccgccacagcaucgagaacuccagcgugaacgugucccugacggccaucgcgaaccaggccaccguccugaugggccucgggaagggcuggccgcugagcaagauggacaucggcgugccccugcucgccaucgggugcuacucccaggugaaccccaucacccugaccgccgcccugcuccugcuggucgcgcacuacgccaucaucggccccgggcuccaggccaaggccacgcgcgaggcccagaagcgggcggccgccggcaucaugaagaacccgaccguggacgggaucaccgugaucgaccuggagcccauccccuacgaccccaaguucgagaagcagcugggccaggucaugcuccuggugcugugcgugacccagguccucaugaugcgcacgaccugggcccugugcgaggcgcugacccucgccaccggcccgaucagcacgcugugggaggggaaccccggcaaguucuggaacaccaccaucgccguguccauggccaacaucuuccgggggagcuaccuggccggcgcgggccuccuguucuccaucaugcgcaacaccacgagcgcccggcgcgggaccggcaccaucggggagacccugggcgagaaguggaagucccggcucaacgcccuggggcgcagcgaguuccagaucuacaagaaguccggcauccaggagguggaccggacgcuggccaaggagggcaucaagcgcggggagaccgaccaccacgccgucagccggggcuccgcgaagcuccgcugguucguggagcggaacaugguggcccccgaggggaaggucguggaccugggcugcgggcgcggcggcuggagcuacuacugcgggggccugaagaacgugcgggaggucaaggggcucaccaagggcgggcccggccacgaggagccgauccccaugagcaccuacggcuggaaccuggugcgccugcaguccgggguggacgucuucuucacgccgcccgagcggugcgacacccuccugugcgacaucggcgagagcuccccgaaccccaccguggaggccgggcgcacccugcgggugcugaaccucgucgagaacuggcugggcagcaacacgcaguucugcaucaaggugcugaaccccuacaugccguccgugaucgagcgcauggagacccuccagcgcaaguucgggggcgcccugguccggaacccccugagccgcaacuccacccacgagauguacugggugagcaacgccuccggcaacaucgugagcuccgucaacaugaucagccggaugcucaucaaccgcuucaccaugcggcacaagaaggcgaccuacgagcccgacguggaccugggguccggcacgcgcaacaucgggaucgagugcgagacccccaacauggacaucaucggcaagcggaucgagaagaucaagcaggagcacgaggccagcuggcacuacgaccaggaccacccguacaagaccugggccuaccacggcuccuacgagaccaagcagacggggagcgccuccagcauggugaacggcgucgugcgccugcucaccaagcccugggacgugauccccauggucacccagauggcgaugaccgacacgacccccuucgggcagcagcggguguucaaggagaagguggacacccgcacccaggagccgaaggagggcacgaagaagcugaugcggaucaccgccgaguggcuguggggcgagcucggccgccggaagaagccccgcaucugcacccgggccgaguucugcaacaagguccgcuccaacgccgcccugggcgcgguguucaccgacgagaacaaguggaaguccgcccgggaggccgucgaggacgagcgcuucugggagcugguggagaaggagcggaaccuccaccuggacgggaagugcgagacgugcguguacaacaugaugggcaagcgcgagaagaagcugggggaguucggcaaggccaaggggagccgggccaucugguacauguggcucggcgcgcgcuuccuggaguucgaggcccugggcuuccucaacgaggaccacugguucucccgcgagaacagccuguccggggucgagggcgaggggcugcacaagcucggcuacauccugcgggacaucagccgcaaggccgggggcgccauguacgccgacgacaccgcgggcugggacacccggaucaccuccgaggaccugaagaacgaggagaugaucacggaccagauggaggggcgccacaagaagcucgccgaggccaucuuccggcugaccuaccagaacaagguggugcgcguccagcggcccacgccccgcggcaccgugauggacaucaucagccggcgcgaccagcggggguccggccaggugggcaccuacgggcugaacaccuucaccaacauggaggcccagcucauccgccagauggagggcgaggggcuguucaagagcauccugcaccucaccccgcaggaggagacggcgguccacgccuggcuggugcgggagggccgcgagcggcuggcccgcauggccaucuccggggacgacugcguggucaagccccucgacgaccgguucgcccgcgcgcugaccgcccugaacgacaugggcaaggugcggaaggacauccagcagugggagcccagcaagggcugguccgacuggacccaggugcccuucugcagccaccacuuccacgagcucaucaugaaggacgggcgcaagcuggucgugccgugccgcaaccaggacgagcugaucggccgggcccgcaucucccagggggccggcuggagccuccgggagaccgccugccuggggaaguccuacgcgcagauguggagccugauguacuuccaccgccgggaccuccgccuggccgccaacgccaucugcuccgccgugcccagccacuggguccccacgagccggaccaccugguccauccacgcgagccacgaguggaugaccacggaggacaugcuggccguguggaaccgcguguggauccaggacaaccccuggauggaggacaagaccccggucgaguccugggaggacauccccuaccucggcaagcgggaggaccaguggugcggcagccugaucgggcugaccucccgcgccaccugggccaagaacauccagaccgccaucaaccaggugcgggcgcucaucggcgaggaggaguacauggacuacaugcccagcaugaagcgcuuccgguccgaggaggaggagagcggggugcugugguga

SEQ ID NO: 9777 - RNA, 9876 nt, Artificial Sequence
  derived and/or modified CDS sequence (opt1) from DENV-2__AF119661__SS-prME
accgugggggucaucaucaugcugauccccaccgccauggccuuccaccucaccacccgcaacggggagccccacaugaucgugggccggcaggagaaggggaagucccugcuguucaagaccgaggacggcgugaacaugugcacccucauggcgaucgaccugggggagcugugcgaggacaccaucaccuacaagugcccccuccugcgccagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcuccgagggggccuggaagcacgcccagcggaucgagaccuggauccugcgccaccccggcuucaucaucauggccgcgauccuggccuacaccaucgggaccacccacuuccagcgggcccucaucuucauccugcugacggccguggcgcccagcaugaccaugcgcugcaucggcguguccaaccgggacuucgucgagggcgugagcgggggcuccuggguggacaucguccucgagcacgggagcugcgugaccaccauggccaagaacaagcccacgcuggacuucgagcugaucaagaccgaggccaagcagcccgugacccuccgcaaguacugcaucaaggccaagcugaccaacacgaccaccgagucccggugcccgacccagggcgagcccagccugaacgaggagcaggacaagcgcuucgucugcaagcacuccaugguggaccggggcugggggaacggcugcgggcuguucggcaagggcgggaucgugacgugcgccaccuucacgugcaagaagaacauggagggcaagaucguccagcccgagaaccuggaguacaccaucgugaucacgccccacagcggggaggagcacgcggugggcaacgacaccgggaagcacggcaaggagaucaagaucaccccgcaguccagcaucaccgaggccgagcugaccggguacggcacggucaccauggagugcagcccccggaccggccucgacuucaacgagauggugcugcugcagauggaggacaaggccuggcucgugcaccggcagugguuccuggaccugccccuccccuggcugccgggggccgacacccagggcagcaacuggauccagaaggagacgcuggucaccuucaagaacccccacgccaagaagcaggacguggucgugcucgggucccaggagggcgcgaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgucauccgcgugcaguacgagggcgacggcucccccugcaagauccccuucgagaucauggaccuggagaagcggcacgugcucgggcgccugaucaccgucaacccgaucgugaccgagaaggacagccccgugaacaucgaggccgagccgcccuucggcgacuccuacaucaucaucggggucgagccgggccagcugaagcucaacugggugaagaaggggagcuccaucggccagauguucgagaccacgaugcgcggcgcgaagcggauggccauccugggggacaccgccugggacuucggcagccucggcgggguguucaccuccaucgggaaggcccuccaccaggucuucggggccaucuacggcgcggccuucagcgggguguccuggaccaugaagauccugaucggcgugaucaucacguggaucgggaugaacagccgcuccaccagccuguccgucagccuggugcucgugggcgucaucacccuguaccugggggccauggugcaggccgacuccggcugcguggucagcuggaagaacaaggagcucaagugcggcuccgggaucuucaucaccgacaacgugcacacguggaccgagcaguacaaguuccagcccgagagccccagcaagcuggcguccgccauccagaaggcccacgaggagggcaucugcgggauccggagcgugacccgccuggagaaccucauguggaagcagaucacccccgagcugaaccacauccuguccgagaacgaggucaagcucacgaucaugaccggcgacaucaaggggaucaugcaggccggcaagcggagccugcgcccgcagcccaccgagcugaaguacuccuggaagaccuggggcaaggccaagaugcucagcacggagucccacaaccagaccuuccugaucgacgggcccgagaccgcggagugcccgaacaccaaccgggccuggaacagccuggagguggaggacuacggcuucgggguguucacgaccaacaucuggcucaagcugcgcgagaagcaggacgucuucugcgacuccaagcugaugagcgccgccaucaaggacaaccgggccgugcacgcggacaugggcuacuggaucgaguccgcccucaacgacaccuggaagauggagaaggccagcuucaucgaggugaaguccugccacuggcccaagagccacacccugugguccaacggcguccuggagagcgagaugaucauccccaaguccuucgccgggcccgugagccagcacaacuaccgcccgggcuacuacacccagacggccgggcccuggcaccucggcaagcuggagauggacuucgacuucugcgaggggaccaccguggucgugaccgaggacugcggcaaccggggccccagccugcgcacgaccaccgcguccgggaagcucaucaccgaguggugcugccggagcugcacgcugcccccgcugcgcuaccggggcgaggacgggugcugguacggcauggagauccgcccccucaaggagaaggaggagucccugguggacagccuggucaccgccgggcacggccagaucgacaacuucucccucggcgugcuggggauggcccuguuccucgaggagaugcugcggacccgcgugggcaccaagcacgccauccugcucgucgcggugagcuucgugacgcugaucaccgggaacaugucccugcgggaccucggccgcgucauggugauggugggggccaccaugaccgacgacaucggcaugggcgucacguaccuggcccugcucgccgccuucaaggugcgccccaccuucgcggccgggcugcugcuccggaagcugaccagcaaggagcugaugauggccaccaucggcaucgcccuccugucccagagcacgauccccgagaccauccuggagcucaccgacgcccuggcgcuggggaugauggugcucaagaucguccgcaacauggagaaguaccagcuggccgugaccaucauggccaucuccugcgugccgaacgccgucauccugcagaacgccuggaaggugagcugcacgauccucgcggccgucuccgugagcccccugcugcucaccuccagccagcagaaggccgacuggaucccccuggcccugaccaucaagggccucaaccccaccgcgaucuuccugacgacccuggcccggaccuccaagaagcgcagcuggccgcucaacgaggccaucauggccgugggcauggucuccauccuggccagcagccugcucaagaacgacauccccaugaccgggccccugguggcgggcgggcugcucacggugugcuacguccugaccggccgguccgccgaccuggagcucgagcgcgccaccgacgugaagugggaggaccaggccgagaucagcggguccagccccauccuguccaucaccaucagcgaggacggcuccaugagcaucaagaacgaggaggaggagcagacgcugaccauccucauccggaccggccugcuggugaucuccggccucuucccggucagcauccccaucaccgccgcggccugguaccugugggaggugaagaagcagcgcgccggcgugcugugggacguccccagcccgccgcccguggagaaggccgagcucgaggacggggccuaccggaucaagcagaagggcauccugggguacagccagaucggcaccggcguguacaaggaggggacguuccacaccauguggcacgucacccgcggcgcggugcugaugcaccgggggaagcgcaucgagcccuccugggccgacgugaagaaggaccucaucagcuacggcgggggcuggaagcuggagggcgaguggaaggagggggaggagguccaggugcuggcccucgagcccggcaagaacccccgggccgugcagaccaagcccgggcuguucaagacgaacaccggcaccaucggggccgucucccuggacuucagccccggcaccuccggcagccccaucguggaccgcaaggggaagguggucggccucuacgggaacggcguggugacgcgguccggcgcguacgucagcgccaucgcccagaccgagaaguccaucgaggacaaccccgagaucgaggacgacaucuuccgcaagaagcggcugaccaucauggaccugcaccccggggccggcaagaccaagcgcuaccugcccgcgaucgugcgggaggccaucaagcgcgggcuccggacgcugauccuggccccgacccgcguggucgccgccgagauggaggaggcgcuccgcggccugcccauccgguaccagacccccgccauccgcgccgagcacaccgggcgggagaucguggaccugaugugccacgccacguucaccaugcgccuccugucccccgugcgggucccgaacuacaaccugaucaucauggacgaggcccacuucaccgaccccgcgaacaucgccgcccgcggcuacaucagcacccggguggagaugggcgaggccgccgggaucuucaugacggcgacgccgcccggcucccgcgacccguucccccagagcaacgcccccaucauggacgaggagcgggagauccccgagcgcuccuggaacagcgggcacgagugggugaccgacuucaagggcaagaccgucugguucgugccguccaucaaggccgggaacgacaucgccgcgugccuccggaagaacggcaagaaggugauccagcugagccgcaagacguucgacuccgaguacgucaagacccggaccaacgacugggacuucguggugaccacggacaucagcgagaugggcgccaacuucaaggccgagcgcgucaucgacccccggcgcugcaugaagcccgugauccugaccgacggggaggagcgggugauccucgccggccccaugccggucacccacuccagcgccgcgcagcgccgggggcgcaucggccgcaaccccaagaacgagaacgaccaguacaucuacaugggggagccccuggagaacgacgaggacugcgcccacuggaaggaggccaagaugcugcucgacaacaucaacacccccgagggcaucaucccguccauguucgagcccgagcgggagaagguggacgccaucgacggcgaguaccgccugcgcggggaggcccgcaagacguucguggaccugaugcggcgcggcgaccuccccgucuggcuggcguaccggguggccgccgaggggaucaacuacgccgaccgccgguggugcuucgacggcgugaagaacaaccagauccuggaggagaacgucgagguggagaucuggaccaaggagggggagcgcaagaagcucaagccgcgguggcuggacgcccgcaucuacagcgacccccuggcgcucaaggaguucaaggaguucgccgccggccggaagucccugacccugaaccucaucaccgagaugggccgccugcccacguucaugacccagaaggcccgggacgcgcuggacaaccucgccguccugcacaccgccgaggccgggggccgcgccuacaaccacgcgcugagcgagcuccccgagacccuggagacgcugcuccugcugacccuccuggccaccgugaccgggggcaucuuccuguuccucauguccggcaagggggugggcaagaugacccuggggaugugcugcaucaucacggccagcauccugcucugguacgcccagauccagccgcacuggaucgccgcguccaucauccuggaguucuuccugaugguccuccugauccccgagcccgagaagcagcggacgccccaggacaaccagcugaccuacguggugaucgccauccucaccgucguggccgccacgauggccaacgagaugggcuuccuggagaagaccaagaaggaccuggggcucggcagcaucgcgacccaggagccggagagcaacauccuggacaucgaccugcgccccgccuccgccuggacccucuacgccguggccacgaccuucgucacccccaugcugcggcacagcaucgagaacuccagcgugaacgugucccugaccgcgaucgccaaccaggccacgguccucaugggccuggggaagggcuggccccugagcaagauggacaucggggugccgcuccuggccaucggcugcuacucccaggugaaccccaucacccugaccgcggcccuccugcugcucgucgcccacuacgccaucaucgggcccggccugcaggccaaggcgacccgcgaggcccagaagcgggccgccgccggcaucaugaagaaccccacgguggacgggaucaccgugaucgaccuggacccgauccccuacgaccccaaguucgagaagcagcucggccaggucaugcugcugauccucugcgugacccaggugcugaugaugcgcaccacgugggcgcugugcgaggcccucacccuggccaccgggcccaucagcacccugugggagggcaacccggggcgcuucuggaacacgaccaucgccgucuccauggccaacaucuuccggggcagcuaccucgcgggcgccgggcugcuguucuucaucaugaagaacaccaccaacacgcgccggggcaccgggaacaucggcgagacccucggcgagaaguggaagucccgccugaacgcccugggcaagagcgaguuccagaucuacaagaaguccggcauccaggagguggaccggacccucgccaaggaggggaucaagcgcggcgagacggaccaccacgcggugagccggggguccgccaagcugcgcugguucgucgagcggaacauggugacccccgagggcaagguggucgaccugggcugcgggcgcggcggguggagcuacuacugcggcgggcucaagaacgugcgggaggugaagggccugaccaagggcgggcccggccacgaggagcccaucccgauguccaccuacggguggaaccugguccgccuccagagcggcguggacguguucuucacgccgcccgagaagugcgacacccugcugugcgacaucggggaguccagccccaacccgaccaucgaggccggccggacccuccgcguccugagccugguggagaacuggcucaacaacgacacccaguucugcaucaaggugcugaaccccuacaugcccuccgucaucgagaagauggagacgcugcagcggaaguacggcggggcccuggugcgcaacccgcucagccggaacuccacccacgagauguacugggugagcaacgccaccggcaacaucgucuccagcgugaacaugaucucccgcaugcugaucaaccgguucaccaugaagcacaagaaggcgacguacgagcccgacguggaccuggggagcggcacccgcaacaucgggaucgaguccgagauccccaaccucgacaucaucggcaagcgcaucgagaagaucaagcaggagcacgagaccagcuggcacuacgaccaggaccaccccuacaagaccugggccuaccacggcuccuacgagacgaagcagaccgggagcgccuccagcauggucaacggcguggugcggcugcugaccaagccgugggacgucgugcccauggugacccagauggccaugacggacaccacccccuucgggcagcagcgcgucuucaaggagaagguggacacccggacgcaggagcccaaggagggcaccaagaagcucaugaagaucaccgccgaguggcuguggaaggagcugggcaagaagaagaccccgcgcaugugcacgcgggaggaguucacccgcaaggugcgguccaacgcggcccucggggccaucuucaccgacgagaacaaguggaaguccgcccgcgaggccgucgaggacaaccgguucugggagcugguggacaaggagcgcaaccugcaccucgagggcaagugcgagaccugcgucuacaacaugauggggaagcgggagaagaagcugggcgaguucgggaaggcgaagggcucccgcgccaucugguacauguggcugggcgcccgguuccucgaguucgaggcccugggguuccugaacgaggaccacugguucagccgcgagaacucccucagcggcguggagggggagggccugcacaagcugggguacauccuccgggacgugagcaagaaggagggcggcgcgauguacgccgacgacacggccgggugggacacccgcaucacccuggaggaccugaagaacgaggagauggucaccaaccacauggagggcgagcacaagaagcucgccgaggccaucuucaagcugacguaccagaacaaggcggugcgggugcagcgccccacgccccgggggaccgucauggacaucaucucccgccgggaccagcgcggcagcggccaggugggcaccuacggccugaacacguucaccaacauggaggcccagcucauccgccagauggagggggagggcaucuucaaguccauccagcaccugaccgugaccgaggagaucgccguccagaacuggcuggcccggguggggcgcgagcggcucagccgcauggccaucuccggcgacgacugcguggucaagccccuggacgaccgguucgcgagcgcccugacggcccucaacgacaugggcaaggugcgcaaggacauccagcagugggagccgucccggggguggaacgacuggacccaggugcccuucugcagccaccacuuccacgagcugaucaugaaggacggccgcguccugguggugcccugccggaaccaggacgagcucaucgggcgcgcccggaucucccagggcgccggguggagccugaaggagaccgcgugccugggcaaguccuacgcccagauguggagccucauguacuuccaccgccgggaccugcgccuggccgccaacgccaucugcuccgcgguccccagccacugggugccgaccucccggaccacguggagcauccacgccaagcacgaguggaugaccaccgaggacaugcucaccguguggaaccgcgucuggauccaggagaaccccuggauggaggacaagacgcccguggaguccugggaggaggugcccuaccugggcaagcgggaggaccaguggugcgggagccugaucggccucaccagccgcgccaccugggccaagaacauccagaccgcgaucaaccagguccggucccugaucgggaacgaggaguacacggacuacaugccgagcaugaagcgcuuccgccgggaggaggaggaggccggcgugcugugguga

SEQ ID NO: 9778 - RNA, 9876 nt, Artificial Sequence
  derived and/or modified CDS sequence (opt1) from DENV-2__EU056810__SS-prME
accgccggcaucaucaucaugcugauccccaccgugauggccuuccaccucaccacccggaacggggagccccacaugaucgucucccggcaggagaagggcaagucccugcuguucaagaccgaggacggggugaacaugugcacccucauggcgauggaccugggcgagcugugcgaggacaccaucaccuacaacugcccccuccugcggcagaacgagcccgaggacaucgacugcuggugcaacagcaccuccaccugggugaccuacgggaccugcaccgccaccggcgagcaccggcgggagaagcggagcgucgcccuggugccccacgugggcauggggcucgagacgcgcaccgagaccuggauguccagcgagggcgccuggaagcacgcccagcggaucgagaccuggauccugcggcaccccggguucacgaucauggcggccauccuggccuacaccaucggcaccaccuacuuccagcggguccucaucuucauccugcugacggccguggcgcccuccaugaccaugcgcugcaucgggaucagcaaccgggacuucguggagggcgucuccggcgggagcuggguggacaucgugcucgagcacggcuccugcgucaccaccauggccaagaacaagcccacgcuggacuucgagcugaucaagaccgaggccaagcagcccgccacccuccgcaaguacugcaucgaggccaagcugaccaacacgaccaccgcgagccggugcccgacccagggggagcccucccugaacgaggagcaggacaagcgcuucgugugcaagcacagcaugguggaccggggcuggggcaacgggugcggccucuucgggaagggcgggaucgucacgugcgccauguucacgugcaagaagaacauggagggcaagguggugcagcccgagaaccuggaguacaccaucgucaucacgccccacuccggcgaggagaacgccguggggaacgacacgggcaagcacgggaaggagaucaagaucaccccgcagagcuccaucaccgaggccgagcugaccggcuacgggaccgugacgauggagugcagcccccgcaccggccucgacuucaacgagaugguccugcugcagauggagaacaaggccuggcucgugcaccggcagugguuccuggaccugccccuccccuggcugccgggcgcggacacccagggguccaacuggauccagaaggagacccuggugacguucaagaacccccacgccaagaagcaggacgucgugguccucggcagccaggagggggccaugcacaccgcccugaccggcgccaccgagauccagaugagcuccgggaaccuccuguucacgggccaccugaagugccgccugcggauggacaagcuccagcugaagggcaugagcuacuccaugugcaccgggaaguucaagguggugaaggagaucgcggagacccagcacggcaccaucgucgugcgcgugcaguacgagggggacggcagccccugcaagauccccuucgagaucauggaccuggagaagcggcacguccucggccgccugaucacggugaacccgaucgugaccgagaaggacucccccgucaacaucgaggccgagccgcccuucggggacagcuacaucaucaucggcguggagccggggcagcugaagcucaacugguucaagaagggcuccagcaucgggcagauguucgagaccaccaugcgcggcgccaagcggauggccauccugggcgacacggccugggacuucgggucccugggcgggguguucaccagcaucggcaaggcgcuccaccaggucuucggggccaucuacggcgccgccuucuccggcgugagcuggaccaugaagauccugaucgggguggucaucaccuggaucggcaugaacucccgcagcacgucccugagcgugucccuggugcucgucgggguggugacccuguaccugggcgucauggugcaggcggacagcgggugcguggucuccuggaagaacaaggagcucaagugcggcagcggcaucuucgugaccgacaacgugcacaccuggacggagcaguacaaguuccagcccgagagccccuccaagcuggccagcgccauccagaaggcccacgaggaggggaucugcggcauccgguccgucacccgccuggagaaccucauguggaagcagaucacccccgagcugaaccacauccugagcgagaacgaggugaagcucaccaucaugacgggggacaucaagggcaucaugcaggccgggaagcggucccugcgcccgcagcccaccgagcugaaguacagcuggaagaccuggggcaaggcgaagaugcucuccaccgagcugcacaaccagacguuccugaucgacggccccgagaccgccgagugcccgaacaccaaccgggccuggaacagccucgagguggaggacuacggguucggcgucuucaccacgaacaucuggcugaagcugaaggagcgccaggacguguucugcgacuccaagcucaugagcgccgccaucaaggacaaccgggcggugcacgccgacaugggguacuggaucgaguccgcccugaacgacaccuggaagaucgagaaggccagcuucaucgaggucaaguccugccacuggcccaagagccacacccugugguccaacggcgugcucgagagcgagaugaucauccccaagaacuucgccggccccgugucccagcacaacuaccgcccgggguaccacacccagaccgcgggccccuggcaccuggggaagcuggaggucgacuucaacuucugcgagggcacgaccgugguggucaccggggacugcggcaaccggggccccagccuccgcaccacgaccgccagcgggaagcugaucaccgaguggugcugccgguccugcacccugcccccgcuccgcuaccggggcgaggacgggugcugguacggcauggagauccgcccccugaaggagaaggaggagaaccuggugaacagccucgugacggccgggcacggccagaucgacaacuucucccugggcguccuggggauggcccucuuccuggaggagaugcugcggacccgcgugggcaccaagcacgcgauccuccugguggccgucagcuucgugacccugaucacggggaacauguccuuccgggaccucggccgcgugauggucauggugggggccaccaugaccgacgacaucggcaugggcgugaccuaccuggcccugcucgccgcguucaagguccgccccacguucgccgccgggcugcugcuccggaagcugaccagcaaggagcugaugaugaccaccaucggcaucgugcuccugucccagagcacgauccccgagaccguccuggagcucaccgacgcccuggcccuggggaugauggugcucaagaucgugcgcaacauggagaaguaccagcuggcggucaccaucauggccauccugugcgugccgaacgccgugauccuccagaacgccuggaaggucuccugcacgauccuggccguggugagcgucagcccccugcuccugaccagcucccagcagaaggcggacuggaucccccuggcccucaccaucaagggccugaaccccaccgccaucuuccugacgacccucagccggaccuccaagaagcgcagcuggccgcugaacgaggccaucauggcggugggcaugguguccauccuggccagcucccuccugaagaacgacauccccaugaccgggccccuggucgccggcgggcuccugacggugugcuacgugcugaccggccggagcgccgaccucgagcuggagcgcgccgcggacguccggugggaggaccaggccgagaucagcggguccagccccauccuguccaucaccaucagcgaggacggcuccaugagcaucaagaacgaggaggaggagcagacccucacgauccugauccgcaccggccugcucgugaucuccgggcuguucccggugagcauccccaucaccgccgccgccugguaccugugggaggucaagaagcagcgggcgggcgugcucugggacgugcccagcccgccgcccgucgggaaggccgagcuggaggacggcgccuaccgcaucaagcagaaggggauccugggcuacagccagaucggcgccgggguguacaaggagggcaccuuccacaccauguggcacgugacgcgcggggccguccucaugcacaagggcaagcgcaucgagcccuccugggcggacgugaagaaggaccugaucagcuacgggggcggcuggaagcuggagggggaguggaaggagggcgaggaggugcagguccucgcccuggagcccgggaagaacccccgggccgugcagaccaagcccggccuguucaagaccaacaccgggacgaucggcgccgugucccucgacuucagccccggcaccuccgggagccccaucgucgacaagaagggcaaggugguggggcuguacggcaacggcgucgugacccgcuccgggaccuacgugagcgccaucgcgcagacggagaaguccaucgaggacaaccccgagaucgaggacgacaucuuccggaagaagcgccugaccaucauggaccugcaccccggcgccgggaagaccaagcgguaccuccccgccaucguccgcgaggccaucaagcggggccugcgcacccugauccucgcgccgacgcgggugguggccgccgagauggaggaggcccugcgcgggcugcccauccgcuaccagacccccgccauccgggcggagcacaccggccgcgagaucgucgaccucaugugccacgccaccuucacgaugcggcugcugagccccgugcgcgugccgaacuacaaccucaucaucauggacgaggcccacuucaccgaccccgccagcaucgccgcgcggggcuacaucuccacccgcgucgagaugggggaggccgccggcaucuucaugaccgccacgccgcccgggagccgggacccguucccccaguccaacgcccccaucauggacgaggagcgcgagauccccgagcggagcuggaacuccggccacgagugggugaccgacuucaaggggaagaccgugugguucgucccgagcaucaaggcgggcaacgacaucgccgccugccugcgcaagaacggcaagaaggugauccagcugucccggaagaccuucgacagcgaguacaucaagacgcgcaccaacgacugggacuucguggucaccaccgacaucuccgagaugggggccaacuucaaggcggagcgggugaucgacccccgccggugcaugaagcccgugauccucacggacggcgaggagcgcgucauccuggccgggcccaugccggugacccacagcuccgccgcccagcggcgcggccggaucgggcgcaaccccaagaacgagaacgaccaguacaucuacaugggcgagccccuggagaacgacgaggacugcgcccacuggaaggaggcgaagaugcuccuggacaacaucaacacccccgagggcaucaucccgagcauguucgagcccgagcgcgagaaggucgacgccaucgacggggaguaccggcugcgcggcgaggcccggaagaccuucguggaccucaugcgccgcggggaccugcccguguggcuggccuaccgcgucgccgcggagggcaucaacuacgccgaccggcgcuggugcuucgacgggaucaagaacaaccagauccucgaggagaacguggagguggagaucuggacgaaggagggcgagcggaagaagcugaagccgcgcuggcuggacgcccggaucuacuccgacccccucgcccugaaggaguucaaggaguucgccgcgggccgcaagagccugacccucaaccugaucaccgagauggggcggcugcccaccuucaugacgcagaaggcccgcaacgcccucgacaaccuggccguccugcacaccgcggaggccggcgggcgggccuacaaccacgcccucuccgagcugcccgagacccuggagacccuccugcugcucacgcugcuggccaccgugaccggcggcaucuuccucuuccugaugagcgggaagggcaucgggaagaugacccugggcaugugcugcaucaucaccgcguccauccuccugugguacgcccagauccagccgcacuggaucgccgccagcaucauccuggaguucuuccucaucgugcugcugauccccgagcccgagaagcagcgcacgccccaggacaaccagcucaccuacgucgugaucgccauccugaccguggucgcggccaccauggccaacgagaugggguuccuggagaagacgaagaaggacuucggccucggcuccaucgccacccagcagccggagagcaacauccuggacaucgaccugcggcccgccagcgcguggacccucuacgccguggccaccacguucaucacccccaugcugcgccacuccaucgagaacagcuccgugaacgucagccugaccgccaucgccaaccaggcgaccgugcucauggggcugggcaagggguggccccuguccaagauggacaucggcgugccgcuccuggccaucgggugcuacagccaggucaaccccaucacgcugaccgccgcccuccugcugcucguggcgcacuacgccaucaucggccccggccugcaggccaaggccacccgggaggcccagaagcgcgcggccgccgggaucaugaagaaccccaccguggacggcaucacggucaucgaccuggacccgauccccuacgaccccaaguucgagaagcagcucggccaggugaugcugcuggugcucugcgucacccaggugcugaugaugcggaccaccugggcccugugcgaggcccucacgcuggcgaccggccccaucuccacccugugggaggggaacccgggccgcuucuggaacaccacgaucgccgugagcauggccaacaucuuccgcggcuccuaccucgccggggccggccugcuguucagcaucaugaagaacaccgcgaacacccggcgcgggaccggcaacacgggcgagacccucggggagaaguggaagaaccggcugaacgcccugggcaaguccgaguuccagaucuacaagaaguccgggauccaggaggucgaccgcacccucgccaaggagggcaucaagcgcggggagaccgaccaccacgccgugucccgcggcagcgcgaagcugcggugguucguggagcgcaaccuggucacgcccgagggcaaggugguggaccucgggugcggccgcggcgggugguccuacuacugcggcgggcugaagaacguccgcgaggugaaggggcugaccaagggcgggcccgggcacgaggagcccaucccgaugagcaccuacggcuggaaccucgugcggcugcaguccggggucgacguguucuucacgccgcccgagaagugcgacacgcugcucugcgacaucggcgagagcucccccaacccgaccaucgaggccggccgcacccugcgggugcugaaccucgucgagaacuggcugaacaacaacacccaguucugcaucaaggugcugaaccccuacaugcccagcgugaucgagaagauggaggcccugcagcgcaaguacgggggcgcccucguccggaacccgcugagccgcaacuccacccacgagauguacugggugagcaacgccuccgggaacaucgugagcuccgucaacaugaucagccggaugcugaucaaccgcuucacgaugcggcacaagaaggcgaccuacgagcccgacguggaccucggcuccgggacccgcaacaucggcaucgagagcgagacccccaaccuggacaucaucggcaagcgcaucgagaagaucaagcaggagcacgagacguccuggcacuacgaccaggaccaccccuacaagaccugggccuaccacgggagcuacgagaccaagcagaccggcuccgccagcuccauggugaacggggucgugcggcugcucacgaagccgugggacgugauccccaccgucacccagauggccaugaccgacacgacccccuucggccagcagcgcguguucaaggagaaggucgacacccggacccaggagcccaaggagggcacgaagaagcugaugaagaucaccgccgaguggcuguggaaggagcucgggaagaagaagaccccgcgcaugugcacccgggaggaguucacgcgcaaggugcggagcaacgcggcccugggcgccaucuucaccgacgagaacaaguggaaguccgcccgcgaggccguggaggacagccgguucugggagcuggucgacaaggagcgcaaccuccaccuggaggggaagugcgagaccugcguguacaacaugaugggcaagcgggagaagaagcugggggaguucggcaaggcgaagggcucccgcgccaucugguacauguggcucggggcccgguuccuggaguucgaggcccugggcuuccucaacgaggaccacugguucagccgcgagaacucccugagcgggguggagggcgaggggcugcacaagcucggcuacauccugcgggacgucagcaagaaggagggcggggcgauguacgccgacgacaccgccggcugggacacgcgcaucacccuggaggaccucaagaacgaggagauggugaccaaccacauggagggggagcacaagaagcuggccgaggccaucuucaagcugaccuaccagaacaaggugguccgggugcagcgccccacgccccggggcaccgugauggacaucaucucccgccgggaccagcgcgggagcggccaggucggcaccuacgggcucaacaccuucacgaacauggaggcgcagcugauccgccagauggagggcgaggggguguucaaguccauccagcaccugaccgugaccgaggagaucaccgucaagaacuggcucgcccgggugggccgcgagcggcugagccgcauggccaucuccggcgacgacugcguggucaagccccuggacgaccgguucgccagcgcccucacggcgcugaacgacauggggaaggugcgcaaggacauccagcagugggagccgucccggggcuggaacgacuggacccaggugcccuucugcagccaccacuuccacgagcugaucaugaaggacgggcgcguccucguggugcccugccggaaccaggacgagcugaucggccgcgcccggaucucccagggggccggcuggagccugcgcgagaccgccugccucggcaaguccuacgcccagauguggagccugauguacuuccaccggcgcgaccugcggcucgcggccaacgccaucugcuccgccguccccagccacugggugccgaccucccgcaccacguggagcauccacgcccggcacgaguggaugaccaccgaggacaugcugaccguguggaaccgcgucuggauccaggagaaccccuggauggaggacaagacgcccguggaguccugggaggagauccccuaccuggggaagcgggaggaccaguggugcggcagccucaucgggcugaccagccgcgcgaccugggccaagaacauccagaccgccaucaaccaggugcgcucccugaucggcaacgaggaguacacggacuacaugccgagcaugaagcgguuccgccgggaggaggaggaggccgggguccucugguga

SEQ ID NO: 9779 - RNA, 9876 nt, Artificial Sequence
  derived and/or modified CDS sequence (opt1) from DENV-2__EU056811__SS-prME
accgcgggcaugaucaucaugcugauccccaccgugauggccuuccaccucaccacccgcaacggggagccccacaugaucgucagccggcaggagaagggcaagagccugcuguucaagaccaaggacgggaccaacaugugcacccucauggcgauggaccugggcgagcugugcgaggacaccaucaccuacaagugccccuuccucaagcagaacgagcccgaggacaucgacugcuggugcaacagcaccagcaccugggugaccuacgggaccugcaccacgaccggcgagcaccgccgggagaagcgcagcguggcccuggucccccacgugggcauggggcuggagacccggaccgagacguggauguccagcgagggcgccuggaagcacgcccagcgcaucgagaccuggauccuccggcaccccggguucaccaucauggccgcgauccuggccuacaccaucggcacgacccacuuccagcgcgugcugaucuucauccuccugaccgccaucgcccccuccaugaccaugcggugcaucgggaucagcaaccgcgacuucgucgagggcguguccggcgggagcuggguggacaucguccuggagcacggcuccugcgugacgaccauggcgaagaacaagcccacccucgacuucgagcugaucaagaccgaggccaagcagcccgccacgcugcggaaguacugcaucgaggccaagcucaccaacaccaccacggacagccgcugcccgacccagggggagcccacccugaacgaggagcaggacaagcgguucgugugcaagcacuccauggucgaccgcggcuggggcaacgggugcggccuguucgggaagggcgggaucgugaccugcgccauguucacgugcaagaagaacauggagggcaagaucgugcagcccgagaaccucgaguacaccgucgugaucacgccccacagcggcgaggagcacgcgguggggaacgacaccggcaagcacgggaaggaggucaagaucaccccgcaguccagcaucacggaggccgagcugaccggcuacgggaccgugaccauggagugcagcccccggacgggccuggacuucaacgagauggugcuccugcagauggaggacaaggccuggcugguccaccgccagugguuccucgaccugccccugcccuggcucccgggcgccgacacccaggggagcaacuggauccagaaggagacccuggugaccuucaagaacccccacgccaagaagcaggacguggucgugcugggcucccaggagggggcgaugcacacggcccucaccggcgccaccgagauccagaugagcagcgggaaccugcuguucaccggccaccucaagugccggcugcgcauggacaagcugcagcucaagggcauguccuacagcaugugcacggggaaguucaagaucgucaaggagaucgccgagacccagcacggcaccaucgugauccgggugcaguacgagggggacggcucccccugcaagauccccuucgagaucauggaccuggagaagcgccacguccugggccggcucaucaccgugaacccgaucgugacggagaaggacagccccgucaacaucgaggccgagccgcccuucggggacuccuacaucaucaucggcguggagccggggcagcugaagcuggacugguucaagaagggcagcuccaucgggcagauguucgagaccaccaugcgcggcgcgaagcgcauggccauccucggcgacaccgccugggacuucgggagccugggcgggguguucacguccaucggcaaggcccugcaccaggucuucggggccaucuacggcgcggccuucagcggcguguccuggaccaugaagauccucaucggggugaucaucaccuggaucggcaugaacagccgguccaccagccuguccgucagccuggugcugguggggaucgucacgcucuaccugggcgugauggugcaggccgacuccgggugcgucgugagcuggaagaacaaggagcugaagugcggcuccggcaucuucgugaccgacaacguccacaccuggaccgagcaguacaaguuccagcccgagagccccagcaagcucgccuccgcgauccagaaggcccacgaggaggggaucugcggcauccgcagcgugacgcggcuggagaaccugauguggaagcagaucaccuccgagcucaaccacauccugagcgagaacgaggugaagcugaccaucaugaccggggacaucaagggcaucaugcaggucgggaagcgcucccuccggccccagccgacggagcugcgcuacagcuggaagaccuggggcaaggccaagaugcuguccaccgagcuccacaaccagaccuuccugaucgacggccccgagacggccgagugccccaacaccaaccgggccuggaacagccuggagguggaggacuacggguucggcguguucaccaccaacaucuggcuccgccugcgggagaagcaggacgcguucugcgacuccaagcugaugagcgccgccaucaaggacaaccgcgccguccacgccgacaugggguacuggaucgaguccgcgcucaacgacaccuggaagaucgagaaggccagcuucaucgaggugaaguccugccacuggcccaagucccacacgcugugguccaacggcgugcuggagagcgagauggucauccccaagaacaucgccggccccgugucccagcacaacaaccggcccggguaccacacccagaccgccggcccguggcaccucgggaagcuggagauggacuucgacuucugcgagggcaccacgguggucgugaccgaggagugcgggaaccgcggccccagccugcggaccaccacggccagcggcaagcucaucaccgaguggugcugccgcuccugcacccugccgccccugcgguaccgcggggaggacggcugcugguacgggauggagauccggccgcucaaggagaaggaggagaaccuggugagcucccuggucaccgcgggccacgggcagaucgacaacuucagccucggcauccugggcauggcccuguuccucgaggagaugcugcgcacgcggguggggaccaagcacgccauccugcucguggccgucuccuuccugacccugaucaccggcaacaugagcuuccgcgaccucgggcgcgugauggugauggucggcgcgacgaugaccgacgacaucgggaugggcgugaccuaccuggcccugcucgccgccuucaaggugcggcccaccuucgccgcgggccugcugcuccgcaagcugacguccaaggagcugaugaugaccaccaucgggaucguccuccugagccaguccagcauccccgagaccauccuggagcucacggacgcccuggcccugggcaugauggugcucaagauggugcggaacauggagaaguaccagcuggccgucaccaucauggccauccugugcgugcccaacgcggugauccuccagaacgccuggaaggucuccugcaccacccuggccguggucagcguguccccgcugcuccugacgagcucccagcagaaggccgacuggaucccccuggcccucaccaucaaggggcugaaccccaccgcgaucuuccugaccacgcucacccgcaccagcaagaagcgguccuggccccugaacgaggccaucauggccgugggcauggucagcauccuggccuccagccuccugaagaacgacaucccgaugaccggcccccugguggccggcgggcuccugacggugugcuacguccugaccgggcgcagcgccgaccucgagcuggagcgggccaccgacgugaagugggacgaccaggccgagaucuccgggagcucccccauccugagcaucaccaucuccgaggacgggagcauguccaucaagaacgaggaggaggagcagacccucacgauccugauccgcaccggccugcucgugaucagcggccuguuccccgucuccaucccgaucaccgccgcggccugguaccugugggaggugaagaagcagcgggccggggugcucugggacguccccuccccgccgcccgugggccgcgccgagcuggaggacggggccuaccggaucaagcagaagggcauccugggguacucccagaucggcgcgggcguguacaaggaggggaccuuccacacgauguggcacgucacccgcggcgccgugcucaugcacaaggggaagcggaucgagcccagcugggccgacgugaagaaggaccugaucuccuacggcgggggcuggaagcuggagggcgaguggaaggagggggaggagguccaggugcucgcccuggagcccggcaagaacccccgcgccgugcagaccaagcccgggcuguuccggaccaacacgggcaccaucggggcggucagccucgacuucucccccggcaccagcggcucccccaucguggacaagaaggggaagguggucggccuguacgggaacggcguggugacccgcggcggggccuacgucagcgccaucgcccagacggagaagggcaucgaggacaacccggagaucgaggacgacaucuuccggaagcgccggcugaccaucauggaccugcaccccggggccggcaagaccaagcgcuaccuccccgcgaucgugcgggaggccaucaagcgcgggcugcgcacccugauccucgcccccacgcggguggucgccgcggagauggaggaggcccugcgcggccugccgauccgguaccagacccccgccauccgcgccgagcacaccggccgggagaucguggaccucaugugccacgccaccuucacgaugcgccugcugucccccauccgggugcccaacuacaaccucaucaucauggacgaggcgcacuucaccgacccggccagcaucgccgcccgcggguacaucagcacccgggucgagaugggcgaggccgcggggaucuucaugaccgccacgccgcccggcucccgcgaccccuucccgcagagcaacgcccccaucauggacgaggagcgggagauccccgagcgcuccuggaacagcgggcacgagugggugaccgacuucaagggcaagaccgugugguucguccccuccaucaagaccggcaacgacaucgccgccugccugcggaagaacgggaagcgcgugauccagcugagccggaagacguucgacuccgaguacgugaagacccgcaccaacgacugggacuucgucgugaccacggacaucagcgagaugggcgcgaacuucaaggccgagcgggugaucgacccgcgccggugcaugaagcccgucauccucaccgacggggaggagcgcgugauccuggccggccccaugcccgugacccacuccagcgccgcgcagcgccgggggcgcaucggccggaacccgcgcaacgagaacgaccaguacaucuacaugggcgagccccuggagaacgacgaggacugcgcccacuggaaggaggccaagaugcuccuggacaacaucaacacccccgaggggaucauccccuccauguucgagccggagcgggagaaggucgacgccaucgacggcgaguaccgccugcgcggggaggcccgcaagacguucguggaccucaugcggcgcggcgaccugcccguguggcuggcguacaaggucgccgccgaggggaucaacuacgccgaccggcgcuggugcuucgacggcacccggaacaaccagauccucgaggagaacguggagguggagaucuggaccaaggagggcgagcgcaagaagcugaagccccgguggcuggacgcccgcaucuacagcgacccgcucgcgcugaaggaguucaaggaguucgccgccgggcggaagucccugacccucaaccugaucacggagaugggccgccugcccaccuucaugacccagaaggcccgggacgcccucgacaaccuggcgguccugcacaccgccgaggccgggggcaaggccuacaaccacgcgcucagcgagcugcccgagacccuggagacgcuccugcugcucacccugcuggccaccgugaccggcgggaucuuccucuuccugauguccggccgcgggaucggcaagaugacgcuggggaugugcugcaucaucaccgccagcauccuccugugguacgcccagauccagccccacuggaucgccgcguccaucauccuggaguucuuccucaucguccugcugaucccggagcccgagaagcagcggacgccccaggacaaccagcucaccuacgugaucaucgccauccugacgguggucgccgccaccauggccaacgagaugggcuuccuggagaagaccaagaaggaccucggccuggggcacaucgcgacccagcagcccgagagcaacauccuggacaucgaccuccgcccggccuccgccuggacgcuguacgccguggccaccaccuucaucacccccaugcugcgccacagcaucgagaacagcuccgugaacgucagccucacggcgaucgccaaccaggccaccgugcugaugggccuggggaagggcuggccccucuccaagauggacaucggggugccccugcuggccaucggcugcuacagccaggucaacccgaucacccucaccgccgcgcugcugaugcucguggcccacuacgccaucaucggccccgggcugcaggccaaggcgacgcgggaggcccagaagcgcgccgccgccggcaucaugaagaaccccaccguggacgggaucaccgucaucgaccuggaccccaucccguacgaccccaaguucgagaagcagcucggccaggugaugcugcuggugcucugcgucacccaggugcugaugaugcggacgaccugggcgcugugcgaggcccucacccuggccaccgggcccguguccacgcugugggagggcaaccccggccgcuucuggaacaccaccaucgccgucagcauggccaacaucuuccggggguccuaccucgcgggcgccgggcugcuguucagcaucaugaagaacaccacguccacccgccggggcaccggcaacaugggggagacccucggcgagaaguggaagaaccgccugaacgcccugggcaagagcgaguuccagaucuacaagaaguccggcauccaggagguggaccggacgcucgccaaggaggggaucaagcgcggcgagaccgaccaccacgccgugagccggggcuccgcgaagcugcgcugguucgucgagcggaaccuggugaccccggaggggaagguggucgaccucggcugcgggcgcggcggguggagcuacuacugcggcggccugaagaacgugcgggaggugaaggggcugaccaagggcgggcccggccacgaggagcccauccccauguccaccuacggguggaaccucguccgccugcagagcggcguggacguguucuucgucccgcccgagaagugcgacacgcugcucugcgacaucggcgaguccagccccaaccccaccguggaggccgggcggacccugcgcgugcugaaccucgucgagaacuggcugaacaacaacacccaguucugcgugaaggugcugaacccguacaugcccuccgucaucgagcggauggagacgcugcagcgcaaguacggcggggcccucgugcgcaacccccugagccggaacagcacccacgagauguacuggguguccaacgccagcggcaacaucgucuccagcgugaacaugaucucccgcaugcugaucaaccgguucaccaugcgccacaagaaggcgaccuacgagccggacguggaccucgggagcggcacgcggaacaucggcaucgaguccgagacccccaaccuggacaucaucgggaagcgcaucgagaagaucaagcaggagcacgagaccagcuggcacuacgaccaggaccaccccuacaagaccugggccuaccacggcuccuacgagacgaagcagaccgggagcgccuccagcauggucaacggcguggugcggcugcucaccaagcccugggacgucaucccgauggugacccagauggccaugacggacaccacccccuucggccagcagcgcguguucaaggagaaggucgacacccggacgcaggagcccaaggaggggaccaagaagcugaugaagaucaccgccgaguggcuguggaaggagcucggcaagaagaagacgccccggaugugcacgcgggaggaguucaccaagaaggugcgcuccaacgcggcccugggggccaucuucaccgacgagaacaaguggaaguccgcccgggaggccguggaggacaaccgcuucugggagcuggucgacaaggagcggaaccuccaccuggagggcaagugcgagaccugcguguacaacaugauggggaagcgcgagaagaagcugggcgaguucggcaaggcgaaggggucccgggccaucugguacauguggcucggcgcccgcuuccuggaguucgaggcccugggguuccucaacgaggaccacugguucagccgggagaacucccugagcggcgucgagggggagggccugcacaagcucggcuacauccugcgcgagguguccaagaaggagggcggggccauguacgcggacgacacggccgggugggacacccggaucaccaucgaggaccugaagaacgaggagaugaucaccaaccacauggccggcgagcacaagaagcucgccgaggcgaucuucaagcugacguaccagaacaaggugguccgcgugcagcgcccgacgccccgggggaccgugauggacaucaucagccgccgggaccagcgcggcagcggccaggucgugaccuacgggcugaacaccuucaccaacauggaggcccagcucauccggcagauggagggcgaggggguguucaaguccauccagcaccugaccgccagcgaggagaucgccguccaggacuggcuggugcgcgugggccgggagcgccucucccggauggccaucagcggcgacgacugcgucgugaagccccuggacgaccgcuucgcgaaggcccugaccgcccucaacgacauggggaaggugcggaaggacauccagcagugggagcccucccgcggcuggaacgacuggacccaggucccguucugcagccaccacuuccacgagcugaucaugaaggacgggcggacgcugguggugcccugccgcaaccaggacgagcucaucggccgggcccgcaucucccagggggccggcuggagccugcgggagaccgcgugccugggcaaguccuacgcccagauguggagccucauguacuuccaccgccgggaccugcgccuggccgccaacgccaucugcuccgcgguccccagccacugggugcccaccucccgcaccacguggagcauccacgccucccacgaguggaugaccaccgaggacaugcucaccguguggaaccgggucuggauccuggagaacccguggauggaggacaagacgcccguggagagcugggaggagauccccuaccuggggaagcgcgaggaccaguggugcggcucccucaucgggcugaccagccgggccaccugggccaagaacauccagaccgccaucaaccaggugcgcagccugaucggcaacgaggaguacacggacuacaugcccuccaugaagcgguuccgccgggaggaggaggaggcggggguccucugguga

SEQ ID NO: 9780 - RNA, 9876 nt, Artificial Sequence
  derived and/or modified CDS sequence (opt1) from DENV-2__DQ645545__SS-prME
accgccggcgugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcguggcccuggucccccacgugggcauggggcuggagacccgcaccgagaccuggauguccagccagggcgccuggaagcacgcccagcggaucgagaccugggugcuccgccaccccggguucaccaucauggcggccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcaugguggaccggggcuggggcaacgggugcggccuguucgggaagggcgggaucgucacgugcgccauguucacgugcaagaagaacauggagggcaagguggugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggaggacaaggccuggcugguccaccggcagugguuccucgaccugccccugcccuggcucccgggcgcggacacccagggguccaacuggauccagaaggagacccuggugacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgggaaggacucccccgucaacaucgaggccgagccgcccuucggcgacagcuacaucaucaucgggguggagccgggccagcugaagcuguccugguucaagaaggggagcuccaucggccagauguucgagaccaccaugcgcggcgccaagcggauggccauccucggggacacggccugggacuucggcagccucgggggcguguucaccuccaucgggaaggcgcugcaccaggucuucggcgccaucuacggcgccgccuucagcgggguguccuggaccaugaagauccucaucggcguggucaucaccuggaucgggaugaacagccgcuccacgagccuguccgugagccuggugcuggucggcguggugacccucuaccugggggucauggugcaggcggacuccggcugcguggucagcuggaagaacaaggagcugaagugcggcagcgggaucuucaucaccgacaacgugcacaccuggacggagcaguacaaguuccagcccgagucccccagcaagcucgccuccgccauccagaaggcccacgaggagggcaucugcgggauccggagcgugacccgccuggagaaccugauguggaagcagaucacccccgagcucaaccacauccuguccgagaacgaggucaagcugaccaucaugacgggcgacaucaaggggaucaugcaggccggcaagcggagccuccgcccgcagcccaccgagcugaaguacuccuggaaggcguggggcaaggccaagaugcugagcaccgagcuccacaaccacaccuuccugaucgacgggcccgagacggccgagugcccgaacaccaaccgggccuggaacucccuggagguggaggacuacggcuucgggguguucaccaccaacaucuggcucaagcugaaggagcgccaggacgucuucugcgacagcaagcugauguccgccgcgaucaaggacaaccgggccgugcacgccgacaugggcuacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcggggcccgugagccagcacaacuaccgcccgggcuaccacacccagaccgccgggcccuggcaccucggcaagcuggagauggacuucgacuucugcgaggggaccacgguggucgugaccgaggacugcggcaaccggggccccagccugcgcaccaccacggccuccgggaagcucaucaccgaguggugcugccggagcugcacccugcccccgcugcgcuaccggggcgaggacgggugcugguacggcauggagauccgcccccucaaggagaaggaggagaaccuggugaacucccuggucaccgccgggcacggccagaucgacaacuucagccucggcgugcuggggauggcgcuguuccucgaggagaugcugcggacgcgcgugggcaccaagcacgccauccugcucgucgccguguccuucgugacccugaucaccgggaacaugagcuuccgggaccugggccgcgucauggugauggugggggccacgaugaccgacgacaucggcaugggcgucaccuaccucgcccugcuggcggccuucaaggugcgccccaccuucgccgccgggcuccugcugcggaagcucacguccaaggagcugaugaugaccaccaucggcaucguccugcucagccaguccaccauccccgagacgauccuggagcugaccgacgcccucgcgcuggggaugauggugcugaagaucgugcgcaacauggagaaguaccagcucgccgucaccaucauggccauccugugcgugccgaacgccgugauccugcagaacgccuggaaggucagcugcaccauccucgcggugguguccgucagcccccugcugcucacguccagccagcagaaggccgacuggaucccccuggcccugaccaucaagggccucaaccccaccgccaucuuccugaccacgcugucccggaccagcaagaagcgcuccuggccgcucaacgaggcgaucauggccgugggcauggugagcauccuggccuccagccugcucaagaacgacauccccaugaccgggccccuggucgccggcgggcugcucaccgugugcuacgugcugacgggccggagcgccgaccuggagcucgagcgcgcggccgacguccggugggaggagcaggccgagaucuccgggagcucccccauccugagcaucaccaucuccgaggacggcagcauguccaucaagaacgaggaggaggagcagacccugaccauccucauccgcacgggccugcuggugaucagcgggcuguucccgguguccauccccaucaccgccgccgcgugguaccugugggaggucaagaagcagcgggccggcgugcugugggacgugcccagcccgccgcccgucgggaaggccgagcucgaggacggcgccuaccgcaucaagcagaaggggauccugggcuacucccagaucggcgccgggguguacaaggagggcaccuuccacaccauguggcacgugacccgcggggcgguccugaugcacaagggcaagcgcaucgagcccagcugggccgacgugaagaaggaccucaucuccuacgggggcggcuggaagcuggagggggaguggaaggagggcgaggaggugcagguccuggcccucgagcccgggaagaacccccgggccgugcagacgaagcccggccuguucaagaccaacaccgggaccaucggcgccgugagccuggacuucucccccggcacgagcgggucccccaucgucgacaagaagggcaaggugguggggcucuacggcaacggcgucgugacccgcagcgggaccuacguguccgcgaucgcccagaccgagaaguccaucgaggacaaccccgagaucgaggacgacaucuuccggaagaagcgccugacgaucauggaccugcaccccggcgccgggaagaccaagcgguaccugcccgccaucguccgcgaggcgaucaagcggggccuccgcacccugauccuggccccgacccgggugguggccgccgagauggaggaggcccuccgcgggcugcccauccgcuaccagacgcccgcgauccgggccgagcacaccggccgcgagaucgucgaccugaugugccacgccaccuucaccaugcggcuccugagccccauccgcgugccgaacuacaaccugaucaucauggacgaggcccacuucacggaccccgccuccaucgcggcccggggcuacaucagcacccgcguggagaugggggaggccgccggcaucuucaugaccgccacgccgcccgggucccgggacccguucccccagagcaacgcgcccaucauggacgaggagcgcgagauccccgagcgguccuggaacagcggccacgagugggucacggacuucaaggggaagaccgugugguucgugccguccaucaaggccggcaacgacaucgccgccugccuccgcaagaacggcaagaaggucauccagcugagccggaagaccuucgacuccgaguacgugaagacccgcacgaacgacugggacuucguggucaccaccgacaucagcgagaugggggcgaacuucaaggccgagcgggugaucgacccccgccggugcaugaagcccgugauccugaccgacggcgaggagcgcgucauccucgccgggcccaugccggugacgcacuccagcgccgcccagcggcgcggccgggucgggcgcaaccccaagaacgagaacgaccaguacaucuacaugggcgagccccuggagaacgacgaggacugcgcgcacuggaaggaggccaagaugcugcucgacaacaucaacacccccgagggcaucaucccguccauguucgagcccgagcgcgagaagguggacgccaucgacggggaguaccggcugcgcggcgaggcccggaagaccuucguggaccugaugcgccgcggggaccuccccgucuggcuggccuaccgcguggcggccgagggcaucaacuacgccgaccggcgcuggugcuucgacggggugaagaacaaccagauccuggaggagaacgucgagguggagaucuggaccaaggagggcgagcggaagaagcucaagccgcgcuggcuggacgcccggaucuacagcgacccccuggcccucaaggaguucaaggaguucgcggccggccgcaagucccugacgcugaaccucaucaccgagauggggcggcugcccaccuucaugacccagaaggcccgcaacgcccuggacaaccucgcggugcugcacacggccgaggccggcgggcgggccuacaaccacgcccugagcgagcuccccgagacccuggagacccugcuccugcugacccuccuggcgacggucaccggcggcaucuuccuguuccucauguccgggaagggcaucgggaagaugacccugggcaugugcugcaucaucaccgccagcgugcugcucugguacgcccagauccagccgcacuggaucgccgccuccaucauccuggaguucuuccugaucgugcuccugauccccgagcccgagaagcagcgcacgccccaggacaaccagcugacguacgucgugaucgcgauccucaccguggucgccgccaccauggccaacgagaugggguuccuggagaagaccaagaaggacuucggccugggcgggaucgccacgcagcagccggagagcaacauccucgacaucgaccugcggcccgcgagcgccuggacccuguacgccguggccaccaccuucaucacgcccaugcuccgccacuccaucgagaacagcuccgugaacgucagccugaccgccaucgcgaaccaggccaccgugcugaugggccucgggaagggcuggccccuguccaagauggacaucggggugccgcugcucgccaucggcugcuacagccaggucaaccccaucacccugacggccgcgcugcuccugcugguggcccacuacgccaucaucggccccgggcuccaggccaaggccacccgggaggcgcagaagcgcgccgccgccggcaucaugaagaaccccaccguggacgggaucaccgucaucgaccuggacccgauccccuacgaccccaaguucgagaagcagcugggccaggugaugcuccuggugcugugcgucacccaggugcucaugaugcggaccaccugggcccugugcgaggcgcugacccucgccacggggcccaucuccacccugugggagggcaacccgggccgcuucuggaacaccaccaucgccgugagcauggccaacaucuuccgcggguccuaccuggccggcgcggggcuccuguucagcaucaugaagaacacggccaacacccggcgcggcaccggcaacaccggggagacgcugggcgagaaguggaagaaccggcucaacgcccuggggaaguccgaguuccagaucuacaagaaguccggcauccaggaggucgaccgcacccuggccaaggaggggaucaagcggggcgagaccgaccaccacgcggugucccgcggcagcgccaagcuccggugguucguggagcgcaaccuggucacccccgaggggaaggugauggaccugggcugcgggcggggcgggugguccuacuacugcggcggccucaagaacgugaaggaggucaaggggcugacgaagggcgggcccggccacgaggagcccaucccgaugagcaccuacggguggaaccuggugcgccuccaguccggcguggacgucuucuucacgccgcccgagaagugcgacacccugcugugcgacaucggcgagagcucccccaacccgacgguggaggccgggcggacccuccgcgugcugaaccuggucgagaacuggcucaacaacaacacccaguucugcaucaaggugcugaaccccuacaugcccagcgugaucgagaagauggaggcccugcagcggaaguacggcggggcccugguccgcaacccgcucagccggaacuccacccacgagauguacugggugagcaacgcguccggcaacaucgugagcuccgucaacaugaucagccgcaugcugaucaaccgguucaccaugcgccacaagaaggccacguacgagcccgacguggaccugggguccggcacccggaacaucggcaucgagagcgagacccccaaccucgacaucaucgggaagcgcaucgagaagaucaagcaggagcacgagaccuccuggcacuacgaccaggaccaccccuacaagacgugggccuaccacggcagcuacgagaccaagcagaccggguccgccagcuccauggugaacggcgucgugcgccugcugaccaagccgugggacgucauccccauggugacgcagauggccaugaccgacaccacccccuucggccagcagcggguguucaaggagaaggucgacacgcgcacccaggagcccaaggaggggaccaagaagcucaugaagaucaccgcggaguggcuguggaaggagcugggcaagaagaagacgccgcggaugugcacccgcgaggaguucacccggaaggugcgcagcaacgccgcccucggggccaucuucaccgacgagaacaaguggaaguccgcccgggaggcgguggaggacagcggcuucugggagcuggucgacaaggagcgcaaccugcaccucgaggggaagugcgagacgugcguguacaacaugaugggcaagcgggagaagaagcugggcgaguucgggaaggccaagggcucccgcgccaucugguacauguggcugggggcccgguuccucgaguucgaggcgcugggcuuccugaacgaggaccacugguucagccgcgagaacucccucagcgggguggagggcgagggccugcacaagcugggguacauccuccgggacgucagcaagaaggagggcggggccauguacgccgacgacaccgccggcugggacacccgcaucacccuggaggaccugaagaacgaggagauggugacgaaccacauggagggggagcacaagaagcucgccgaggcgaucuucaagcugaccuaccagaacaaggugguccgggugcagcgccccacgccccggggcaccgugauggacaucaucucccgccgggaccagcgcggcagcgggcaggucgugacguacggccugaacaccuucaccaacauggaggcccagcucauccggcagauggagggggagggcguguucaaguccauccagcagcugaccgccacggaggagaucgccgucaagaacuggcuggcccgcgugggccgcgagcggcucagccgcauggcgaucuccggggacgacugcguggucaagccccuggacgaccgguucgccagcgcccugaccgcccucaacgacaugggcaaggugcgcaaggacauccagcagugggagccgucccggggguggaacgacuggacccaggugcccuucugcagccaccacuuccacgagcugaucaugaaggacggccgcguccugguggugcccugccggaaccaggacgagcucaucgggcgcgcccggaucucccagggcgcgggcuggagccugcgcgagaccgccugccuggggaaguccuacgcccagauguggagccucauguacuuccaccggcgcgaccugcggcuggccgccaacgcgaucugcuccgccguccccagccacugggugccgacgucccgcaccaccuggagcauccacgccacccacgaguggaugaccacggaggacaugcucaccguguggaaccgggucuggauccaggagaaccccuggaucgaggacaagacccccguggaguccugggaggagauccccuaccugggcaagcgcgaggaccaguggugcgggagccugaucggccucaccagccgggccacgugggcgaagaacauccagaccgccaucaaccaggugcgcucccugaucgggaacgaggaguacaccgacuacaugccgagcaugaagcgguuccgccgcgaggaggaggaggccggcguccugugguga

SEQ ID NO: 9781 - RNA, 9876 nt, Artificial Sequence
  derived and/or modified CDS sequence (opt1) from DENV-2__DQ645546__SS-prME
accgccggcgugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcguggcccuggucccccacgugggcauggggcuggagacccggaccgagaccuggauguccagcgagggcgccuggaagcacgcccagcggaucgagaccugggugcuccgccaccccggguucaccaucauggcggccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcaugguggaccggggcuggggcaacgggugcggccuguucgggaagggcgggaucgucacgugcgccauguucacgugcaagaagaacauggagggcaagguggugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggaggacaaggccuggcugguccaccggcagugguuccucgaccugccccugcccuggcucccgggcgcggacacccagggguccaacuggauccagaaggagacccuggugacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggagguggaggacuacggguucggcguguucaccaccaacaucuggcucaagcugaaggagcgccaggacgucuucugcgacagcaagcugauguccgccgcgaucaaggacaaccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggaagcuggagauggacuucgacuucugcgagggcaccacgguggucgugaccgaggacugcgggaaccggggccccagccugcgcaccaccacggccuccggcaagcucaucaccgaguggugcugccggagcugcacccugcccccgcugcgcuaccgcggggaggacggcugcugguacgggauggagauccgcccccucaaggagaaggaggagaaccuggugaacucccuggucaccgccggccacgggcagaucgacaacuucagccucggcgugcugggcauggcgcuguuccucgaggagaugcugcggacgcgcguggggaccaagcacgccauccugcucgucgccguguccuucgugacccugaucaccggcaacaugagcuuccgggaccuggggcgcgucauggugauggugggcgccacgaugaccgacgacaucgggaugggcgucaccuaccucgcccugcuggcggccuucaaggugcgccccaccuucgccgccggccuccugcugcggaagcucacguccaaggagcugaugaugaccaccaucgggaucguccugcucagccaguccaccauccccgagacgauccuggagcugaccgacgcccucgcgcugggcaugauggugcugaagaucgugcgcaacauggagaaguaccagcucgccgucaccaucauggccauccugugcgugccgaacgccgugauccugcagaacgccuggaaggucagcugcaccauccucgcggugguguccgucagcccccugcugcucacguccagccagcagaaggccgacuggaucccccuggcccugaccaucaaggggcucaaccccaccgccaucuuccugaccacgcugucccggaccagcaagaagcgcuccuggccgcucaacgaggcgaucauggccgugggcauggugagcauccuggccuccagccugcucaagaacgacauccccaugaccggcccccuggucgccgggggccugcucaccgugugcuacgugcugacggggcggagcgccgaccuggagcucgagcgcgcggccgacguccggugggaggagcaggccgagaucuccggcagcucccccauccugagcaucaccaucuccgaggacgggagcauguccaucaagaacgaggaggaggagcagacccugaccauccucauccgcacgggccugcuggugaucagcggccucuucccgguguccauccccaucaccgccgccgcgugguaccugugggaggucaagaagcagcgggccggggugcugugggacgugcccagcccgccgcccgucggcaaggccgagcucgaggacggggccuaccgcaucaagcagaagggcauccugggguacucccagaucggcgccggcguguacaaggaggggaccuuccacaccauguggcacgugacccggggcgcgguccugaugcacaaggggaagcgcaucgagcccagcugggccgacgugaagaaggaccucaucuccuacggcgggggcuggaagcuggagggcgaguggaaggagggggaggaggugcagguccuggcccucgagcccggcaagaacccccgggccgugcagacgaagcccgggcuguucaagaccaacaccggcaccaucggggccgugagccuggacuucucccccggcacgagcggcucccccaucgucgacaagaaggggaagguggugggccucuacgggaacggcgucgugacccgcagcggcaccuacguguccgcgaucgcccagaccgagaaguccaucgaggacaaccccgagaucgaggacgacaucuuccggaagaagcgccugacgaucauggaccugcaccccggggccggcaagaccaagcgguaccugcccgccaucguccgcgaggcgaucaagcgggggcuccgcacccugauccuggccccgacccgggugguggccgccgagauggaggaggcccuccgcggccugcccauccgcuaccagacgcccgcgauccgggccgagcacaccgggcgcgagaucgucgaccugaugugccacgccaccuucaccaugcggcuccugagccccauccgcgugccgaacuacaaccugaucaucauggacgaggcccacuucacggaccccgccuccaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucacggacuucaagggcaagaccgugugguucgugccguccaucaaggccgggaacgacaucgccgccugccuccgcaagaacggcaagaaggucauccagcugagccggaagaccuucgacuccgaguacgugaagacccgcacgaacgacugggacuucguggucaccaccgacaucagcgagaugggcgcgaacuucaaggccgagcgggugaucgacccccgccggugcaugaagcccgugauccugaccgacggggaggagcgcgucauccucgccggccccaugccggugacgcacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucguggaccugaugcgccggggcgaccuccccgucuggcuggccuaccgcguggcggccgaggggaucaacuacgccgaccggcgcuggugcuucgacggcgugaagaacaaccagauccuggaggagaacgucgagguggagaucuggaccaaggagggggagcggaagaagcucaagccgcgcuggcuggacgcccggaucuacagcgacccccuggcccucaaggaguucaaggaguucgcggccggccgcaagucccugacgcugaaccucaucaccgagaugggccggcugcccaccuucaugacccagaaggcccgcaacgcccuggacaaccucgcggugcugcacacggccgaggccgggggccgggccuacaaccacgcccugagcgagcuccccgagacccuggagacccugcuccugcugacccuccuggcgacggucaccgggggcaucuuccuguuccucauguccggcaaggggaucggcaagaugacccuggggaugugcugcaucaucaccgccagcgugcugcucugguacgcccagauccagccgcacuggaucgccgccuccaucauccuggaguucuuccugaucgugcuccugauccccgagcccgagaagcagcgcacgccccaggacaaccagcugacguacgucgugaucgcgauccucaccguggucgccgccaccauggccaacgagaugggcuuccuggagaagaccaagaaggacuucgggcugggcggcaucgccacgcagcagccggagagcaacauccucgacaucgaccugcggcccgcgagcgccuggacccuguacgccguggccaccaccuucaucacgcccaugcuccgccacuccaucgagaacagcuccgugaacgucagccugaccgccaucgcgaaccaggccaccgugcugauggggcucggcaagggguggccccuguccaagauggacaucggcgugccgcugcucgccaucgggugcuacagccaggucaaccccaucacccugacggccgcgcugcuccugcugguggcccacuacgccaucaucggccccggccuccaggccaaggccacccgggaggcgcagaagcgcgccgccgccgggaucaugaagaaccccaccguggacggcaucaccgucaucgaccuggacccgauccccuacgaccccaaguucgagaagcagcugggccaggugaugcuccuggugcugugcgucacccaggugcucaugaugcggaccaccugggcccugugcgaggcgcugacccucgccacgggccccaucuccacccugugggaggggaacccgggccgcuucuggaacaccaccaucgccgugagcauggccaacaucuuccgcggcuccuaccuggccggggcgggccuccuguucagcaucaugaagaacacggccaacacccggcgcgggaccggcaacaccggcgagacgcugggggagaaguggaagaaccggcucaacgcccugggcaaguccgaguuccagaucuacaagaaguccgggauccaggaggucgaccgcacccuggccaaggagggcaucaagcgcggggagaccgaccaccacgcggugucccgcggcagcgccaagcuccggugguucguggagcgcaaccuggucacccccgagggcaaggugauggaccuggggugcggccgcggcgggugguccuacuacugcggcgggcucaagaacgugaaggaggucaaggggcugacgaagggcgggcccgggcacgaggagcccaucccgaugagcaccuacggcuggaaccuggugcgccuccaguccgggguggacgucuucuucacgccgcccgagaagugcgacacccugcugugcgacaucggcgagagcucccccaacccgacgguggaggccggccggacccuccgcgugcugaaccuggucgagaacuggcucaacaacaacacccaguucugcaucaaggugcugaaccccuacaugcccagcgugaucgagaagauggaggcccugcagcggaaguacgggggcgcccugguccgcaacccgcucagccggaacuccacccacgagauguacugggugagcaacgcguccgggaacaucgugagcuccgucaacaugaucagccgcaugcugaucaaccgguucaccaugcgccacaagaaggccacguacgagcccgacguggaccugggcuccgggacccggaacaucggcaucgagagcgagacccccaaccucgacaucaucggcaagcgcaucgagaagaucaagcaggagcacgagaccuccuggcacuacgaccaggaccaccccuacaagacgugggccuaccacgggagcuacgagaccaagcagaccggcuccgccagcuccauggugaacggggucgugcgccugcugaccaagccgugggacgucauccccauggugacgcagauggccaugaccgacaccacccccuucggccagcagcggguguucaaggagaaggucgacacgcgcacccaggagcccaaggagggcaccaagaagcucaugaagaucaccgcggaguggcuguggaaggagcuggggaagaagaagacgccgcggaugugcacccgcgaggaguucacccggaaggugcgcagcaacgccgcccucggcgccaucuucaccgacgagaacaaguggaaguccgcccgggaggcgguggaggacagcggguucugggagcuggucgacaaggagcgcaaccugcaccucgagggcaagugcgagacgugcguguacaacaugauggggaagcgggagaagaagcugggcgaguucggcaaggccaaggggucccgcgccaucugguacauguggcugggcgcccgguuccucgaguucgaggcgcugggguuccugaacgaggaccacugguucagccgcgagaacucccucagcggcguggagggggagggccugcacaagcugggcuacauccuccgggacgucagcaagaaggagggcggggccauguacgccgacgacaccgccgggugggacacccgcaucacccuggaggaccugaagaacgaggagauggugacgaaccacauggagggcgagcacaagaagcucgccgaggcgaucuucaagcugaccuaccagaacaaggugguccgggugcagcgccccacgccccgggggaccgugauggacaucaucucccgccgggaccagcgcggcagcggccaggucgugacguacgggcugaacaccuucaccaacauggaggcccagcucauccggcagauggagggcgaggggguguucaaguccauccagcagcugaccgccacggaggagaucgccgucaagaacuggcuggcccgcgugggccgcgagcggcucagccgcauggcgaucuccggcgacgacugcguggucaagccccuggacgaccgguucgccagcgcccugaccgcccucaacgacauggggaaggugcgcaaggacauccagcagugggagccgucccggggcuggaacgacuggacccaggugcccuucugcagccaccacuuccacgagcugaucaugaaggacgggcgcguccugguggugcccugccggaaccaggacgagcucaucggccgcgcccggaucucccagggggcgggcuggagccugcgcgagaccgccugccugggcaaguccuacgcccagauguggagccucauguacuuccaccggcgcgaccugcggcuggccgccaacgcgaucugcuccgccguccccagccacugggugccgacgucccgcaccaccuggagcauccacgccacccacgaguggaugaccacggaggacaugcucaccguguggaaccgggucuggauccaggagaaccccuggaucgaggacaagacccccguggaguccugggaggagauccccuaccuggggaagcgcgaggaccaguggugcggcagccugaucgggcucaccagccgggccacgugggcgaagaacauccagaccgccaucaaccaggugcgcucccugaucggcaacgaggaguacaccgacuacaugccgagcaugaagcgguuccgccgcgaggaggaggaggccgggguccugugguga

SEQ ID NO: 9782 - RNA, 9876 nt, Artificial Sequence
  derived and/or modified CDS sequence (opt1) from DENV-2__DQ645547__SS-prME
accgccggcgugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcguggcccuggucccccacgugggcauggggcuggagacccggaccgagaccuggauguccagcgagggcgccuggaagcacgcccagcggaucgagaccugggugcuccgccaccccggguucaccaucauggcggccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcaugguggaccggggcuggggcaacgggugcggccuguucgggaagggcgggaucgucacgugcgccauguucacgugcaagaagaacauggagggcaagguggugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggaggacaaggccuggcugguccaccggcagugguuccucgaccugccccugcccuggcucccgggcgcggacacccagggguccaacuggauccagaaggagacccuggugacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggagguggaggacuacggguucggcguguucaccaccaacaucuggcucaagcugaaggagcgccaggacgucuucugcgacagcaagcugauguccgccgcgaucaaggacaaccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggaagcuggagauggacuucgacuucugcgagggcaccacgguggucgugaccgaggacugcgggaaccggggccccagccugcgcaccaccacggccuccggcaagcucaucaccgaguggugcugccggagcugcacccugcccccgcugcgcuaccgcggggaggacggcugcugguacgggauggagauccgcccccucaaggagaaggaggagaaccuggugaacucccuggucaccgccggccacgggcagaucgacaacuucagccucggcgugcugggcauggcgcuguuccucgaggagaugcugcggacgcgcguggggaccaaguacgccauccugcucgucgccguguccuucgugacccugaucaccggcaacaugagcuuccgggaccuggggcgcgucauggugauggugggcgccacgaugaccgacgacaucgggaugggcgucaccuaccucgcccugcuggcggccuucaaggugcgccccaccuucgccgccggccuccugcugcggaagcucacguccaaggagcugaugaugaccaccaucgggaucguccugcucagccaguccaccauccccgagacgauccuggagcugaccgacgcccucgcgcugggcaugauggugcugaagaucgugcgcaacauggagaaguaccagcucgccgucaccaucauggccauccugugcgugccgaacgccgugauccugcagaacgccuggaaggucagcugcaccauccucgcggugguguccgucagcccccugcugcucacguccagccagcagaaggccgacuggaucccccuggcccugaccaucaaggggcucaaccccaccgccaucuuccugaccacgcugucccggaccagcaagaagcgcuccuggccgcucaacgaggcgaucauggccgugggcauggugagcauccuggccuccagccugcucaagaacgacauccccaugaccggcccccuggucgccgggggccugcucaccgugugcuacgugcugacggggcggagcgccgaccuggagcucgagcgcgcggccgacguccggugggaggagcaggccgagaucuccggcagcucccccauccugagcaucaccaucuccgaggacgggagcauguccaucaagaacgaggaggaggagcagacccugaccauccucauccgcacgggccugcuggugaucagcggccucuucccgguguccauccccaucaccgccgccgcgugguaccugugggaggucaagaagcagcgggccggggugcugugggacgugcccagcccgccgcccgucggcaaggccgagcucgaggacggggccuaccgcaucaagcagaagggcauccugggguacucccagaucggcgccggcguguacaaggaggggaccuuccacaccauguggcacgugacccggggcgcgguccugaugcacaaggggaagcgcaucgagcccagcugggccgacgugaagaaggaccucaucuccuacggcgggggcuggaagcuggagggcgaguggaaggagggggaggaggugcagguccuggcccucgagcccggcaagaacccccgggccgugcagacgaagcccgggcuguucaagaccaacaccggcaccaucggggccgugagccuggacuucucccccggcacgagcggcucccccaucgucgacaagaaggggaagguggugggccucuacgggaacggcgucgugacccgcagcggcaccuacguguccgcgaucgcccagaccgagaaguccaucgaggacaaccccgagaucgaggacgacaucuuccggaagaagcgccugacgaucauggaccugcaccccggggccggcaagaccaagcgguaccugcccgccaucguccgcgaggcgaucaagcgggggcuccgcacccugauccuggccccgacccgggugguggccgccgagauggaggaggcccuccgcggccugcccauccgcuaccagacgcccgcgauccgggccgagcacaccgggcgcgagaucgucgaccugaugugccacgccaccuucaccaugcggcuccugagccccauccgcgugccgaacuacaaccugaucaucauggacgaggcccacuucacggaccccgccuccaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucacggacuucaagggcaagaccgugugguucgugccguccaucaaggccgggaacgacaucgccgccugccuccgcaagaacggcaagaaggucauccagcugagccggaagaccuucgacuccgaguacgugaagacccgcacgaacgacugggacuucguggucaccaccgacaucagcgagaugggcgcgaacuucaaggccgagcgggugaucgacccccgccggugcaugaagcccgugauccugaccgacggggaggagcgcgucauccucgccggccccaugccggugacgcacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucguggaccugaugcgccggggcgaccuccccgucuggcuggccuaccgcguggcggccgaggggaucaacuacgccgaccggcgcuggugcuucgacggcgugaagaacaaccagauccuggaggagaacgucgagguggagaucuggaccaaggagggggagcggaagaagcucaagccgcgcuggcuggacgcccggaucuacagcgacccccuggcccucaaggaguucaaggaguucgcggccggccgcaagucccugacgcugaaccucaucaccgagaugggccggcugcccaccuucaugacccagaaggcccgcaacgcccuggacaaccucgcggugcugcacacggccgaggccgggggccgggccuacaaccacgcccugagcgagcuccccgagacccuggagacccugcuccugcugacccuccuggcgacggucaccgggggcaucuuccuguuccucauguccggcaaggggaucggcaagaugacccuggggaugugcugcaucaucaccgccagcgugcugcucugguacgcccagauccagccgcacuggaucgccgccuccaucauccuggaguucuuccugaucgugcuccugauccccgagcccgagaagcagcgcacgccccaggacaaccagcugacguacgucgugaucgcgauccucaccguggucgccgccaccauggccaacgagaugggcuuccuggagaagaccaagaaggacuucgggcugggcggcaucgccacgcagcagccggagagcaacauccucgacaucgaccugcggcccgcgagcgccuggacccuguacgccguggccaccaccuucaucacgcccaugcuccgccacuccaucgagaacagcuccgugaacgucagccugaccgccaucgcgaaccaggccaccgugcugauggggcucggcaagggguggccccuguccaagauggacaucggcgugccgcugcucgccaucgggugcuacagccaggucaaccccaucacccugacggccgcgcugcuccugcugguggcccacuacgccaucaucggccccggccuccaggccaaggccacccgggaggcgcagaagcgcgccgccgccgggaucaugaagaaccccaccguggacggcaucaccgucaucgaccuggacccgauccccuacgaccccaaguucgagaagcagcugggccaggugaugcuccuggugcugugcgucacccaggugcucaugaugcggaccaccugggcccugugcgaggcgcugacccucgccacgggccccaucuccacccugugggaggggaacccgggccgcuucuggaacaccaccaucgccgugagcauggccaacaucuuccgcggcuccuaccuggccggggcgggccuccuguucagcaucaugaagaacacggccaacacccggcgcgggaccggcaacaccggcgagacgcugggggagaaguggaagaaccggcucaacgcccugggcaaguccgaguuccagaucuacaagaaguccgggauccaggaggucgaccgcacccuggccaaggagggcaucaagcgcggggagaccgaccaccacgcggugucccgcggcagcgccaagcuccggugguucguggagcgcaaccuggucacccccgagggcaaggugauggaccuggggugcggccgcggcgggugguccuacuacugcggcgggcucaagaacgugaaggaggucaaggggcugacgaagggcgggcccgggcacgaggagcccaucccgaugagcaccuacggcuggaaccuggugcgccuccaguccgggguggacgucuucuucacgccgcccgagaagugcgacacccugcugugcgacaucggcgagagcucccccaacccgacgguggaggccggccggacccuccgcgugcugaaccuggucgagaacuggcucaacaacaacacccaguucugcaucaaggugcugaaccccuacaugcccagcgugaucgagaagauggaggcccugcagcggaaguacgggggcgcccugguccgcaacccgcucagccggaacuccacccacgagauguacugggugagcaacgcguccgggaacaucgugagcuccgucaacaugaucagccgcaugcugaucaaccgguucaccaugcgccacaagaaggccacguacgagcccgacguggaccugggcuccgggacccggaacaucggcaucgagagcgagacccccaaccucgacaucaucggcaagcgcaucgagaagaucaagcaggagcacgagaccuccuggcacuacgaccaggaccaccccuacaagacgugggccuaccacgggagcuacgagaccaagcagaccggcuccgccagcuccauggugaacggggucgugcgccugcugaccaagccgugggacgucauccccauggugacgcagauggccaugaccgacaccacccccuucggccagcagcggguguucaaggagaaggucgacacgcgcacccaggagcccaaggagggcaccaagaagcucaugaagaucaccgcggaguggcuguggaaggagcuggggaagaagaagacgccgcggaugugcacccgcgaggaguucacccggaaggugcgcagcaacgccgcccucggcgccaucuucaccgacgagaacaaguggaaguccgcccgggaggcgguggaggacagcggguucugggagcuggucgacaaggagcgcaaccugcaccucgagggcaagugcgagacgugcguguacaacaugauggggaagcgggagaagaagcugggcgaguucggcaaggccaaggggucccgcgccaucugguacauguggcugggcgcccgguuccucgaguucgaggcgcugggguuccugaacgaggaccacugguucagccgcgagaacucccucagcggcguggagggggagggccugcacaagcugggcuacauccuccgggacgucagcaagaaggagggcggggccauguacgccgacgacaccgccgggugggacacccgcaucacccuggaggaccugaagaacgaggagauggugacgaaccacauggagggcgagcacaagaagcucgccgaggcgaucuucaagcugaccuaccagaacaaggugguccgggugcagcgccccacgccccgggggaccgugauggacaucaucucccgccgggaccagcgcggcagcggccaggucgugacguacgggcugaacaccuucaccaacauggaggcccagcucauccggcagauggagggcgaggggguguucaaguccauccagcagcugaccgccacggaggagaucgccgucaagaacuggcuggcccgcgugggccgcgagcggcucagccgcauggcgaucuccggcgacgacugcguggucaagccccuggacgaccgguucgccagcgcccugaccgcccucaacgacauggggaaggugcgcaaggacauccagcagugggagccgucccggggcuggaacgacuggacccaggugcccuucugcagccaccacuuccacgagcugaucaugaaggacgggcgcguccugguggugcccugccggaaccaggacgagcucaucggccgcgcccggaucucccagggggcgggcuggagccugcgcgagaccgccugccugggcaaguccuacgcccagauguggagccucauguacuuccaccggcgcgaccugcggcuggccgccaacgcgaucugcuccgccguccccagccacugggugccgacgucccgcaccaccuggagcauccacgccacccacgaguggaugaccacggaggacaugcucaccguguggaaccgggucuggauccaggagaaccccuggaucgaggacaagacccccguggaguccugggaggagauccccuaccuggggaagcgcgaggaccaguggugcggcagccugaucgggcucaccagccgggccacgugggcgaagaacauccagaccgccaucaaccaggugcgcucccugaucggcaacgaggaguacaccgacuacaugccgagcaugaagcgguuccgccgcgaggaggaggaggccgggguccugugguga

SEQ ID NO: 9783 - RNA, 9876 nt, Artificial Sequence
  derived and/or modified CDS sequence (opt1) from DENV-2__DQ645549__SS-prME
accgccggcgugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcguggcccuggucccccacgugggcauggggcuggagacccggaccgagaccuggauguccagcgagggcgccuggaagcacgcccagcggaucgagaccugggugcuccgccaccccggguucaccaucauggcggccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcaugguggaccggggcuggggcaacgggugcggccuguucgggaagggcgggaucgucacgugcgccauguucacgugcaagaagaacauggagggcaagguggugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggaggacaaggccuggcugguccaccggcagugguuccucgaccugccccugcccuggcucccgggcgcggacacccagggguccaacuggauccagaaggagacccuggugacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggagguggaggacuacggguucggcguguucaccaccaacaucuggcucaagcugaaggagcgccaggacgucuucugcgacagcaagcugauguccgccgcgaucaaggacaaccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggaagcuggagauggacuucgacuucugcgagggcaccacgguggucgugaccgaggacugcgggaaccggggccccagccugcgcaccaccacggccuccggcaagcucaucaccgaguggugcugccggagcugcacccugcccccgcugcgcuaccgcggggaggacggcugcugguacgggauggagauccgcccccucaaggagaaggaggagaaccuggugaacucccuggucaccgccggccacgggcagaucgacaacuucagccucggcgugcugggcauggcgcuguuccucgaggagaugcugcggacgcgcguggggaccaagcacgccauccugcucgucgccguguccuucgugacccugaucaccggcaacaugagcuuccgggaccuggggcgcgucauggugauggugggcgccacgaugaccgacgacaucgggaugggcgucaccuaccucgcccugcuggcggccuucaaggugcgccccaccuucgccgccggccuccugcugcggaagcucacguccaaggagcugaugaugaccaccaucgggaucguccugcucagccaguccaccauccccgagacgauccuggagcugaccgacgcccucgcgcugggcaugauggugcugaagaucgugcgcaacauggagaaguaccagcucgccgucaccaucauggccauccugugcgugccgaacgccgugauccugcagaacgccuggaaggucagcugcaccauccucgcggugguguccgucagcccccugcugcucacguccagccagcagaaggccgacuggaucccccuggcccugaccaucaaggggcucaaccccaccgccaucuuccugaccacgcugucccggaccagcaagaagcgcuccuggccgcucaacgaggcgaucauggccgugggcauggugagcauccuggccuccagccugcucaagaacgacauccccaugaccggcccccuggucgccgggggccugcucaccgugugcuacgugcugacggggcggagcgccgaccuggagcucgagcgcgcggccgacguccggugggaggagcaggccgagaucuccggcagcucccccauccugagcaucaccaucuccgaggacgggagcauguccaucaagaacgaggaggaggagcagacccugaccauccucauccgcacgggccugcuggugaucagcggccucuucccgguguccauccccaucaccgccgccgcgugguaccugugggaggucaagaagcagcgggccggggugcugugggacgugcccagcccgccgcccgucggcaaggccgagcucgaggacggggccuaccgcaucaagcagaagggcauccugggguacucccagaucggcgccggcguguacaaggaggggaccuuccacaccauguggcacgugacccggggcgcgguccugaugcacaaggggaagcgcaucgagcccagcugggccgacgugaagaaggaccucaucuccuacggcgggggcuggaagcuggagggcgaguggaaggagggggaggaggugcagguccuggcccucgagcccggcaagaacccccgggccgugcagacgaagcccgggcuguucaagaccaacaccggcaccaucggggccgugagccuggacuucucccccggcacgagcggcucccccaucgucgacaagaaggggaagguggugggccucuacgggaacggcgucgugacccgcagcggcaccuacguguccgcgaucgcccagaccgagaaguccaucgaggacaaccccgagaucgaggacgacaucuuccggaagaagcgccugacgaucauggaccugcaccccggggccggcaagaccaagcgguaccugcccgccaucguccgcgaggcgaucaagcgggggcuccgcacccugauccuggccccgacccgggugguggccgccgagauggaggaggcccuccgcggccugcccauccgcuaccagacgcccgcgauccgggccgagcacaccgggcgcgagaucgucgaccugaugugccacgccaccuucaccaugcggcuccugagccccauccgcgugccgaacuacaaccugaucaucauggacgaggcccacuucacggaccccgccuccaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucacggacuucaagggcaagaccgugugguucgugccguccaucaaggccgggaacgacaucgccgccugccuccgcaagaacggcaagaaggucauccagcugagccggaagaccuucgacuccgaguacgugaagacccgcacgaacgacugggacuucguggucaccaccgacaucagcgagaugggcgcgaacuucaaggccgagcgggugaucgacccccgccggugcaugaagcccgugauccugaccgacggggaggagcgcgucauccucgccggccccaugccggugacgcacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucguggaccugaugcgccggggcgaccuccccgucuggcuggccuaccgcguggcggccgaggggaucaacuacgccgaccggcgcuggugcuucgacggcgugaagaacaaccagauccuggaggagaacgucgagguggagaucuggaccaaggagggggagcggaagaagcucaagccgcgcuggcuggacgcccggaucuacagcgacccccuggcccucaaggaguucaaggaguucgcggccggccgcaagucccugacgcugaaccucaucaccgagaugggccggcugcccaccuucaugacccagaaggcccgcaacgcccuggacaaccucgcggugcugcacacggccgaggccgggggccgggccuacaaccacgcccugagcgagcuccccgagacccuggagacccugcuccugcugacccuccuggcgacggucaccgggggcaucuuccuguuccucauguccggcaaggggaucggcaagaugacccuggggaugugcugcaucaucaccgccagcgugcugcucugguacgcccagauccagccgcacuggaucgccgccuccaucauccuggaguucuuccugaucgugcuccugauccccgagcccgagaagcagcgcacgccccaggacaaccagcugacguacgucgugaucgcgauccucaccguggucgccgccaccauggccaacgagaugggcuuccuggagaagaccaagaaggacuucgggcugggcggcaucgccacgcagcagccggagagcaacauccucgacaucgaccugcggcccgcgagcgccuggacccuguacgccguggccaccaccuucaucacgcccaugcuccgccacuccaucgagaacagcuccgugaacgucagccugaccgccaucgcgaaccaggccaccgugcugauggggcucggcaagggguggccccuguccaagauggacaucggcgugccgcugcucgccaucgggugcuacagccaggucaaccccaucacccugacggccgcgcugcuccugcugguggcccacuacgccaucaucggccccggccuccaggccaaggccacccgggaggcgcagaagcgcgccgccgccgggaucaugaagaaccccaccguggacggcaucaccgucaucgaccuggacccgauccccuacgaccccaaguucgagaagcagcugggccaggugaugcuccuggugcugugcgucacccaggugcucaugaugcggaccaccugggcccugugcgaggcgcugacccucgccacgggccccaucuccacccugugggaggggaacccgggccgcuucuggaacaccaccaucgccgugagcauggccaacaucuuccgcggcuccuaccuggccggggcgggccuccuguucagcaucaugaagaacacggccaacacccggcgcgggaccggcaacaccggcgagacgcugggggagaaguggaagaaccggcucaacgcccugggcaaguccgaguuccagaucuacaagaaguccgggauccaggaggucgaccgcacccuggccaaggagggcaucaagcgcggggagaccgaccaccacgcggugucccgcggcagcgccaagcuccggugguucguggagcgcaaccuggucacccccgagggcaaggugauggaccuggggugcggccgcggcgggugguccuacuacugcggcgggcucaagaacgugaaggaggucaaggggcugacgaagggcgggcccgggcacgaggagcccaucccgaugagcaccuacggcuggaaccuggugcgccuccaguccgggguggacgucuucuucacgccgcccgagaagugcgacacccugcugugcgacaucggcgagagcucccccaacccgacgguggaggccggccggacccuccgcgugcugaaccuggucgagaacuggcucaacaacaacacccaguucugcaucaaggugcugaaccccuacaugcccagcgugaucgagaagauggaggcccugcagcggaaguacgggggcgcccugguccgcaacccgcucagccggaacuccacccacgagauguacugggugagcaacgcguccgggaacaucgugagcuccgucaacaugaucagccgcaugcugaucaaccgguucaccaugcgccacaagaaggccacguacgagcccgacguggaccugggcuccgggacccggaacaucggcaucgagagcgagacccccaaccucgacaucaucggcaagcgcaucgagaagaucaagcaggagcacgagaccuccuggcacuacgaccaggaccaccccuacaagacgugggccuaccacgggagcuacgagaccaagcagaccggcuccgccagcuccauggugaacggggucgugcgccugcugaccaagccgugggacgucauccccauggugacgcagauggccaugaccgacaccacccccuucggccagcagcggguguucaaggucaagguggacacgcgcacccaggagcccaaggagggcaccaagaagcucaugaagaucaccgcggaguggcuguggaaggagcuggggaagaagaagacgccgcggaugugcacccgcgaggaguucacccggaaggugcgcagcaacgccgcccucggcgccaucuucaccgacgagaacaaguggaaguccgcccgggaggcggucgaggacagcggguucugggagcugguggacaaggagcgcaaccugcaccucgagggcaagugcgagacgugcguguacaacaugauggggaagcgggagaagaagcugggcgaguucggcaaggccaaggggucccgcgccaucugguacauguggcugggcgcccgguuccucgaguucgaggcgcugggguuccugaacgaggaccacugguucagccgcgagaacucccucagcggcgucgagggggagggccugcacaagcugggcuacauccuccgggacgugagcaagaaggagggcggggccauguacgccgacgacaccgccgggugggacacccgcaucacccuggaggaccugaagaacgaggagauggugacgaaccacauggagggcgagcacaagaagcucgccgaggcgaucuucaagcugaccuaccagaacaaggucgugcgggugcagcgccccacgccccgggggaccgucauggacaucaucucccgccgggaccagcgcggcagcggccagguggugacguacgggcugaacaccuucaccaacauggaggcccagcucauccggcagauggagggcgagggggucuucaaguccauccagcagcugaccgccacggaggagaucgccgugaagaacuggcuggcccgcgugggccgcgagcggcucagccgcauggcgaucuccggcgacgacugcgucgugaagccccuggacgaccgguucgccagcgcccugaccgcccucaacgacauggggaaggugcgcaaggacauccagcagugggagccgucccggggcuggaacgacuggacccagguccccuucugcagccaccacuuccacgagcugaucaugaaggacgggcgcgugcuggugguccccugccggaaccaggacgagcucaucggccgcgcccggaucucccagggggcgggcuggagccugcgcgagaccgccugccugggcaaguccuacgcccagauguggagccucauguacuuccaccggcgcgaccugcggcuggccgccaacgcgaucugcuccgccgugcccagccacugggugccgacgucccgcaccaccuggagcauccacgccacccacgaguggaugaccacggaggacaugcucaccgucuggaaccggguguggauccaggagaaccccuggaucgaggacaagacccccguggaguccugggaggagauccccuaccuggggaagcgcgaggaccaguggugcggcagccugaucgggcucaccagccgggccacgugggcgaagaacauccagaccgccaucaaccagguccgcucccugaucggcaacgaggaguacaccgacuacaugccgagcaugaagcgguuccgccgcgaggaggaggaggccggggugcugugguga

SEQ ID NO: 9784 - RNA, 9876 nt, Artificial Sequence
  derived and/or modified CDS sequence (opt1) from DENV-2__DQ645550__SS-prME
accgccggcgugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcguggcccuggucccccacgugggcauggggcuggagacccggaccgagaccuggauguccagcgagggcgccuggaagcacgcccagcggaucgagaccugggugcuccgccaccccggguucaccaucauggcggccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcaugguggaccggggcuggggcaacgggugcggccuguucgggaagggcgggaucgucacgugcgccauguucacgugcaagaagaacauggagggcaagguggugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggaggacaaggccuggcugguccaccggcagugguuccucgaccugccccugcccuggcucccgggcgcggacacccagggguccaacuggauccagaaggagacccuggugacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggagguggaggacuacggguucggcguguucaccaccaacaucuggcucaagcugaaggagcgccaggacgucuucugcgacagcaagcugauguccgccgcgaucaaggacaaccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggaagcuggagauggacuucgacuucugcgagggcaccacgguggucgugaccgaggacugcgggaaccggggccccagccugcgcaccaccacggccuccggcaagcucaucaccgaguggugcugccggagcugcacccugcccccgcugcgcuaccgcggggaggacggcugcugguacgggauggagauccgcccccucaaggagaaggaggagaaccuggugaacucccuggucaccgccggccacgggcagaucgacaacuucagccucggcgugcugggcauggcgcuguuccucgaggagaugcugcggacgcgcguggggaccaagcacgccauccugcucgucgccguguccuucgugacccugaucaccggcaacaugagcuuccgggaccuggggcgcgucauggugauggugggcgccacgaugaccgacgacaucgggaugggcgucaccuaccucgcccugcuggcggccuucaaggugcgccccaccuucgccgccggccuccugcugcggaagcucacguccaaggagcugaugaugaccaccaucgggaucguccugcucagccaguccaccauccccgagacgauccuggagcugaccgacgcccucgcgcugggcaugauggugcugaagaucgugcgcaacauggagaaguaccagcucgccgucaccaucauggccauccugugcgugccgaacgccgugauccugcagaacgccuggaaggucagcugcaccauccucgcggugguguccgucagcccccugcugcucacguccagccagcagaaggccgacuggaucccccuggcccugaccaucaaggggcucaaccccaccgccaucuuccugaccacgcugucccggaccagcaagaagcgcuccuggccgcucaacgaggcgaucauggccgugggcauggugagcauccuggccuccagccugcucaagaacgacauccccaugaccggcccccuggucgccgggggccugcucaccgugugcuacgugcugacggggcggagcgccgaccuggagcucgagcgcgcggccgacguccggugggaggagcaggccgagaucuccggcagcucccccauccugagcaucaccaucuccgaggacgggagcauguccaucaagaacgaggaggaggagcagacccugaccauccucauccgcacgggccugcuggugaucagcggccucuucccgguguccauccccaucaccgccgccgcgugguaccugugggaggucaagaagcagcgggccggggugcugugggacgugcccagcccgccgcccgucggcaaggccgagcucgaggacggggccuaccgcaucaagcagaagggcauccugggguacucccagaucggcgccggcguguacaaggaggggaccuuccacaccauguggcacgugacccggggcgcgguccugaugcacaaggggaagcgcaucgagcccagcugggccgacgugaagaaggaccucaucuccuacggcgggggcuggaagcuggagggcgaguggaaggagggggaggaggugcagguccuggcccucgagcccggcaagaacccccgggccgugcagacgaagcccgggcuguucaagaccaacaccggcaccaucggggccgugagccuggacuucucccccggcacgagcggcucccccaucgucgacaagaaggggaagguggugggccucuacgggaacggcgucgugacccgcagcggcaccuacguguccgcgaucgcccagaccgagaaguccaucgaggacaaccccgagaucgaggacgacaucuuccggaagaagcgccugacgaucauggaccugcaccccggggccggcaagaccaagcgguaccugcccgccaucguccgcgaggcgaucaagcgggggcuccgcacccugauccuggccccgacccgggugguggccgccgagauggaggaggcccuccgcggccugcccauccgcuaccagacgcccgcgauccgggccgagcacaccgggcgcgagaucgucgaccugaugugccacgccaccuucaccaugcggcuccugagccccauccgcgugccgaacuacaaccugaucaucauggacgaggcccacuucacggaccccgccuccaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucacggacuucaagggcaagaccgugugguucgugccguccaucaaggccgggaacgacaucgccgccugccuccgcaagaacggcaagaaggucauccagcugagccggaagaccuucgacuccgaguacgugaagacccgcacgaacgacugggacuucguggucaccaccgacaucagcgagaugggcgcgaacuucaaggccgagcgggugaucgacccccgccggugcaugaagcccgugauccugaccgacggggaggagcgcgucauccucgccggccccaugccggugacgcacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucguggaccugaugcgccggggcgaccuccccgucuggcuggccuaccgcguggcggccgaggggaucaacuacgccgaccggcgcuggugcuucgacggcgugaagaacaaccagauccuggaggagaacgucgagguggagaucuggaccaaggagggggagcggaagaagcucaagccgcgcuggcuggacgcccggaucuacagcgacccccuggcccucaaggaguucaaggaguucgcggccggccgcaagucccugacgcugaaccucaucaccgagaugggccggcugcccaccuucaugacccagaaggcccgcaacgcccuggacaaccucgcggugcugcacacggccgaggccgggggccgggccuacaaccacgcccugagcgagcuccccgagacccuggagacccugcuccugcugacccuccuggcgacggucaccgggggcaucuuccuguuccucauguccggcaaggggaucggcaagaugacccuggggaugugcugcaucaucaccgccagcgugcugcucugguacgcccagauccagccgcacuggaucgccgccuccaucauccuggaguucuuccugaucgugcuccugauccccgagcccgagaagcagcgcacgccccaggacaaccagcugacguacgucgugaucgcgauccucaccguggucgccgccaccauggccaacgagaugggcuuccuggagaagaccaagaaggacuucgggcugggcggcaucgccacgcagcagccggagagcaacauccucgacaucgaccugcggcccgcgagcgccuggacccuguacgccguggccaccaccuucaucacgcccaugcuccgccacuccaucgagaacagcuccgugaacgucagccugaccgccaucgcgaaccaggccaccgugcugauggggcucggcaagggguggccccuguccaagauggacaucggcgugccgcugcucgccaucgggugcuacagccaggucaaccccaucacccugacggccgcgcugcuccugcugguggcccacuacgccaucaucggccccggccuccaggccaaggccacccgggaggcgcagaagcgcgccgccgccgggaucaugaagaaccccaccguggacggcaucaccgucaucgaccuggacccgauccccuacgaccccaaguucgagaagcagcugggccaggugaugcuccuggugcugugcgucacccaggugcucaugaugcggaccaccugggcccugugcgaggcgcugacccucgccacgggccccaucuccacccugugggaggggaacccgggccgccuguggaacaccaccaucgccgugagcauggccaacaucuuccgcggcuccuaccucgccggggcgggccugcuguucagcaucaugaagaacacggccaacacccggcgcgggaccggcaacaccggcgagacgcucggggagaaguggaagaaccggcugaacgcccugggcaaguccgaguuccagaucuacaagaaguccgggauccaggaggucgaccgcacccucgccaaggagggcaucaagcgcggggagaccgaccaccacgcggugucccgcggcagcgccaagcugcggugguucguggagcgcaaccuggucacccccgagggcaaggugauggaccucgggugcggccgcggcgggugguccuacuacugcggcgggcugaagaacgugaaggaggucaaggggcugacgaagggcgggcccgggcacgaggagcccaucccgaugagcaccuacggcuggaaccucgugcgccugcaguccgggguggacgucuucuucacgccgcccgagaagugcgacacccugcucugcgacaucggcgagagcucccccaacccgacgguggaggccggccggacccugcgcgugcugaaccucgucgagaacuggcugaacaacaacacccaguucugcaucaaggugcugaaccccuacaugcccagcgugaucgagaagauggaggcccugcagcggaaguacgggggcgcccucguccgcaacccgcugagccggaacuccacccacgagauguacugggugagcaacgcguccgggaacaucgugagcuccgucaacaugaucagccgcaugcugaucaaccgguucaccaugcgccacaagaaggccacguacgagcccgacguggaccucggcuccgggacccggaacaucggcaucgagagcgagacccccaaccuggacaucaucggcaagcgcaucgagaagaucaagcaggagcacgagaccuccuggcacuacgaccaggaccaccccuacaagacgugggccuaccacgggagcuacgagaccaagcagaccggcuccgccagcuccauggugaacggggucgugcgccugcucaccaagccgugggacgucauccccauggugacgcagauggccaugaccgacaccacccccuucggccagcagcggguguucaaggucaagguggacacgcgcacccaggagcccaaggagggcaccaagaagcugaugaagaucaccgcggaguggcuguggaaggagcucgggaagaagaagacgccgcggaugugcacccgcgaggaguucacccggaaggugcgcagcaacgccgcccugggcgccaucuucaccgacgagaacaaguggaaguccgcccgggaggcggucgaggacagcggguucugggagcugguggacaaggagcgcaaccuccaccuggagggcaagugcgagacgugcguguacaacaugauggggaagcgggagaagaagcugggcgaguucggcaaggccaaggggucccgcgccaucugguacauguggcucggcgcccgguuccuggaguucgaggcgcugggguuccucaacgaggaccacugguucagccgcgagaacucccugagcggcgucgagggggagggccugcacaagcucggcuacauccugcgggacgugagcaagaaggagggcggggccauguacgccgacgacaccgccgggugggacacccgcaucacccuggaggaccucaagaacgaggagauggugacgaaccacauggagggcgagcacaagaagcuggccgaggcgaucuucaagcugaccuaccagaacaaggucgugcgggugcagcgccccacgccccgggggaccgucauggacaucaucucccgccgggaccagcgcggcagcggccagguggugacguacgggcucaacaccuucaccaacauggaggcccagcugauccggcagauggagggcgagggggucuucaaguccauccagcagcugaccgccacggaggagaucgccgugaagaacuggcucgcccgcgugggccgcgagcggcugagccgcauggcgaucuccggcgacgacugcgucgugaagccccuggacgaccgguucgccagcgcccucaccgcccugaacgacauggggaaggugcgcaaggacauccagcagugggagccgucccggggcuggaacgacuggacccagguccccuucugcagccaccacuuccacgagcugaucaugaaggacgggcgcgugcucgugguccccugccggaaccaggacgagcugaucggccgcgcccggaucucccagggggcgggcuggagccugcgcgagaccgccugccucggcaaguccuacgcccagauguggagccugauguacuuccaccggcgcgaccugcggcucgccgccaacgcgaucugcuccgccgugcccagccacugggugccgacgucccgcaccaccuggagcauccacgccacccacgaguggaugaccacggaggacaugcugaccgucuggaaccggguguggauccaggagaaccccuggaucgaggacaagacccccguggaguccugggaggagauccccuaccuggggaagcgcgaggaccaguggugcggcagccucaucgggcugaccagccgggccacgugggcgaagaacauccagaccgccaucaaccagguccgcucccugaucggcaacgaggaguacaccgacuacaugccgagcaugaagcgguuccgccgcgaggaggaggaggccggggugcucugguga

SEQ ID NO: 9785 - RNA, 9876 nt, Artificial Sequence
  derived and/or modified CDS sequence (opt1) from DENV-2__DQ645551__SS-prME
accgccggcgugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcguggcccuggucccccacgugggcauggggcuggagacccggaccgagaccuggauguccagcgagggcgccuggaagcacgcccagcggaucgagaccugggugcuccgccaccccggguucaccaucauggcggccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcaugguggaccggggcuggggcaacgggugcggccuguucgggaagggcgggaucgucacgugcgccauguucacgugcaagaagaacauggagggcaagguggugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggaggacaaggccuggcugguccaccggcagugguuccucgaccugccccugcccuggcucccgggcgcggacacccagggguccaacuggauccagaaggagacccuggugacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggagguggaggacuacggguucggcguguucaccaccaacaucuggcucaagcugaaggagcgccaggacgucuucugcgacagcaagcugauguccgccgcgaucaaggacaaccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggaagcuggagauggacuucgacuucugcgagggcaccacgguggucgugaccgaggacugcgggaaccggggccccagccugcgcaccaccacggccuccggcaagcucaucaccgaguggugcugccggagcugcacccugcccccgcugcgcuaccgcggggaggacggcugcugguacgggauggagauccgcccccucaaggagaaggaggagaaccuggugaacucccuggucaccgccggccacgggcagaucgacaacuucagccucggcgugcugggcauggcgcuguuccucgaggagaugcugcggacgcgcguggggaccaagcacgccauccugcucgucgccguguccuucgugacccugaucaccggcaacaugagcuuccgggaccuggggcgcgucauggugauggugggcgccacgaugaccgacgacaucgggaugggcgucaccuaccucgcccugcuggcggccuucaaggugcgccccaccuucgccgccggccuccugcugcggaagcucacguccaaggagcugaugaugaccaccaucgggaucguccugcucagccaguccaccauccccgagacgauccuggagcugaccgacgcccucgcgcugggcaugauggugcugaagaucgugcgcaacauggagaaguaccagcucgccgucaccaucauggccauccugugcgugccgaacgccgugauccugcagaacgccuggaaggucagcugcaccauccucgcggugguguccgucagcccccugcugcucacguccagccagcagaaggccgacuggaucccccuggcccugaccaucaaggggcucaaccccaccgccaucuuccugaccacgcugucccggaccagcaagaagcgcuccuggccgcucaacgaggcgaucauggccgugggcauggugagcauccuggccuccagccugcucaagaacgacauccccaugaccggcccccuggucgccgggggccugcucaccgugugcuacgugcugacggggcggagcgccgaccuggagcucgagcgcgcggccgacguccggugggaggagcaggccgagaucuccggcagcucccccauccugagcaucaccaucuccgaggacgggagcauguccaucaagaacgaggaggaggagcagacccugaccauccucauccgcacgggccugcuggugaucagcggccucuucccgguguccauccccaucaccgccgccgcgugguaccugugggaggucaagaagcagcgggccggggugcugugggacgugcccagcccgccgcccgucggcaaggccgagcucgaggacggggccuaccgcaucaagcagaagggcauccugggguacucccagaucggcgccggcguguacaaggaggggaccuuccacaccauguggcacgugacccggggcgcgguccugaugcacaaggggaagcgcaucgagcccagcugggccgacgugaagaaggaccucaucuccuacggcgggggcuggaagcuggagggcgaguggaaggagggggaggaggugcagguccuggcccucgagcccggcaagaacccccgggccgugcagacgaagcccgggcuguucaagaccaacaccggcaccaucggggccgugagccuggacuucucccccggcacgagcggcucccccaucgucgacaagaaggggaagguggugggccucuacgggaacggcgucgugacccgcagcggcaccuacguguccgcgaucgcccagaccgagaaguccaucgaggacaaccccgagaucgaggacgacaucuuccggaagaagcgccugacgaucauggaccugcaccccggggccggcaagaccaagcgguaccugcccgccaucguccgcgaggcgaucaagcgggggcuccgcacccugauccuggccccgacccgggugguggccgccgagauggaggaggcccuccgcggccugcccauccgcuaccagacgcccgcgauccgggccgagcacaccgggcgcgagaucgucgaccugaugugccacgccaccuucaccaugcggcuccugagccccauccgcgugccgaacuacaaccugaucaucauggacgaggcccacuucacggaccccgccuccaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucacggacuucaagggcaagaccgugugguucgugccguccaucaaggccgggaacgacaucgccgccugccuccgcaagaacggcaagaaggucauccagcugagccggaagaccuucgacuccgaguacgugaagacccgcacgaacgacugggacuucguggucaccaccgacaucagcgagaugggcgcgaacuucaaggccgagcgggugaucgacccccgccggugcaugaagcccgugauccugaccgacggggaggagcgcgucauccucgccggccccaugccggugacgcacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucguggaccugaugcgccggggcgaccuccccgucuggcuggccuaccgcguggcggccgaggggaucaacuacaccgaccggcgcuggugcuucgacggcgugaagaacaaccagauccuggaggagaacgucgagguggagaucuggacgaaggagggggagcggaagaagcucaagccgcgcuggcuggacgcccggaucuacagcgacccccuggcccucaaggaguucaaggaguucgccgcgggccgcaagucccugacccugaaccucaucaccgagaugggccggcugcccaccuucaugacgcagaaggcccgcaacgcccuggacaaccucgccgugcugcacaccgcggaggccgggggccgggccuacaaccacgcccugagcgagcuccccgagacccuggagacccugcuccugcugacgcuccuggccaccgucaccgggggcaucuuccuguuccucauguccggcaaggggaucggcaagaugacccuggggaugugcugcaucaucaccgcgagcgugcugcucugguacgcccagauccagccgcacuggaucgccgccuccaucauccuggaguucuuccugaucgugcuccugauccccgagcccgagaagcagcgcacgccccaggacaaccagcugaccuacgucgugaucgccauccucaccguggucgcggccaccauggccaacgagaugggcuuccuggagaagacgaagaaggacuucgggcugggcggcaucgccacccagcagccggagagcaacauccucgacaucgaccugcggcccgccagcgcguggacccuguacgccguggccaccacguucaucacccccaugcuccgccacuccaucgagaacagcuccgugaacgucagccugaccgccaucgccaaccaggcgaccgugcugauggggcucggcaagggguggccccuguccaagauggacaucggcgugccgcugcucgccaucgggugcuacagccaggucaaccccaucacgcugaccgccgcccugcuccugcugguggcgcacuacgccaucaucggccccggccuccaggccaaggccacccgggaggcccagaagcgcgcggccgccgggaucaugaagaaccccaccguggacggcaucacggucaucgaccuggacccgauccccuacgaccccaaguucgagaagcagcugggccaggugaugcuccuggugcugugcgucacccaggugcucaugaugcggaccaccugggcccugugcgaggcccugacgcucgcgaccggccccaucuccacccugugggaggggaacccgggccgcuucuggaacaccacgaucgccgugagcauggccaacaucuuccgcggcuccuaccuggccggggccggccuccuguucagcaucaugaagaacaccgcgaacacccggcgcgggaccggcaacacgggcgagacccugggggagaaguggaagaaccggcucaacgcccugggcaaguccgaguuccagaucuacaagaaguccgggauccaggaggucgaccgcacccuggccaaggagggcaucaagcgcggggagaccgaccaccacgccgugucccgcggcagcgcgaagcuccggugguucguggagcgcaaccuggucacgcccgagggcaaggugauggaccuggggugcggccgcggcgggugguccuacuacugcggcgggcucaagaacgugaaggaggucaaggggcugaccaagggcgggcccgggcacgaggagcccaucccgaugagcaccuacggcuggaaccuggugcgccuccaguccgggguggacgucuucuucacgccgcccgagaagugcgacacgcugcugugcgacaucggcgagagcucccccaacccgaccguggaggccggccggacccuccgcgugcugaaccuggucgagaacuggcucaacaacaacacccaguucugcaucaaggugcugaaccccuacaugcccagcgugaucgagaagauggaggcccugcagcggaaguacgggggcgcccugguccgcaacccgcucagccggaacuccacccacgagauguacugggugagcaacgccuccgggaacaucgugagcuccgucaacaugaucagccgcaugcugaucaaccgguucacgaugcgccacaagaaggcgaccuacgagcccgacguggaccugggcuccgggacccggaacaucggcaucgagagcgagacccccaaccucgacaucaucggcaagcgcaucgagaagaucaagcaggagcacgagacguccuggcacuacgaccaggaccaccccuacaagaccugggccuaccacgggagcuacgagaccaagcagaccggcuccgccagcuccauggugaacggggucgugcgccugcugacgaagccgugggacgucauccccauggugacccagauggccaugaccgacaccacgcccuucggccagcagcggguguucaaggagaaggucgacacccgcacccaggagcccaaggagggcaccaagaagcucaugaagaucacggccgaguggcuguggaaggagcuggggaagaagaagaccccgcggaugugcacccgcgaggaguucacccggaaggugcgcagcaacgcggcccucggcgccaucuucacggacgagaacaaguggaaguccgcccgggaggccguggaggacagcggguucugggagcuggucgacaaggagcgcaaccugcaccucgagggcaagugcgagaccugcguguacaacaugauggggaagcgggagaagaagcugggcgaguucggcaaggcgaaggggucccgcgccaucugguacauguggcugggcgcccgguuccucgaguucgaggcccugggguuccugaacgaggaccacugguucagccgcgagaacucccucagcggcguggagggggagggccugcacaagcugggcuacauccuccgggacgucagcaagaaggagggcggggcgauguacgccgacgacaccgccgggugggacacccgcaucacgcuggaggaccugaagaacgaggagauggugaccaaccacauggagggcgagcacaagaagcucgccgaggccaucuucaagcugaccuaccagaacaaggugguccgggugcagcgccccacgccccgggggacggugauggacaucaucucccgccgggaccagcgcggcagcggccaggucgugaccuacgggcugaacaccuucaccaacauggaggcgcagcucauccggcagauggagggcgaggggguguucaaguccauccagcagcugacggccaccgaggagaucgccgucaagaacuggcuggcccgcgugggccgcgagcggcucagccgcauggccaucuccggcgacgacugcguggucaagccccuggacgaccgguucgcgagcgcccugaccgcccucaacgacauggggaaggugcgcaaggacauccagcagugggagccgucccggggcuggaacgacuggacccaggugcccuucugcagccaccacuuccacgagcugaucaugaaggacgggcgcguccugguggugcccugccggaaccaggacgagcucaucggccgcgcccggaucucccagggggccggcuggagccugcgcgagacggcgugccugggcaaguccuacgcccagauguggagccucauguacuuccaccggcgcgaccugcggcuggccgccaacgccaucugcuccgcgguccccagccacugggugccgaccucccgcaccaccuggagcauccacgccacccacgaguggaugacgaccgaggacaugcucaccguguggaaccgggucuggauccaggagaaccccuggaucgaggacaagacccccguggaguccugggaggagauccccuaccuggggaagcgcgaggaccaguggugcggcagccugaucgggcucacgagccgggccaccugggccaagaacauccagaccgcgaucaaccaggugcgcucccugaucggcaacgaggaguacaccgacuacaugccgagcaugaagcgguuccgccgcgaggaggaggaggccgggguccugugguga

SEQ ID NO: 9786 - RNA, 9876 nt, Artificial Sequence
  derived and/or modified CDS sequence (opt1) from DENV-2__DQ645552__SS-prME
accgccggcgugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcguggcccuggucccccacgugggcauggggcuggagacccggaccgagaccuggauguccagcgagggcgccuggaagcacgcccagcggaucgagaccugggugcuccgccaccccggguucacgaucauggcggccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcaugguggaccggggcuggggcaacgggugcggccuguucgggaagggcgggaucgucacgugcgccauguucacgugcaagaagaacauggagggcaagguggugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggaggacaaggccuggcugguccaccggcagugguuccucgaccugccccugcccuggcucccgggcgcggacacccagggguccaacuggauccagaaggagacccuggugacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggagguggaggacuacggguucggcguguucaccaccaacaucuggcucaagcugaaggagcgccaggacgucuucugcgacagcaagcugauguccgccgcgaucaaggacaaccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggaagcuggagauggacuucgacuucugcgagggcaccacgguggucgugaccgaggacugcgggaaccggggccccagccugcgcaccaccacggccuccggcaagcucaucaccgaguggugcugccggagcugcacccugcccccgcugcgcuaccgcggggaggacggcugcugguacgggauggagauccgcccccucaaggagaaggaggagaaccuggugaacucccuggucaccgccggccacgggcagaucgacaacuucagccucggcgugcugggcauggcgcuguuccucgaggagaugcugcggacgcgcguggggaccaagcacgccauccugcucgucgccguguccuucgugacccugaucaccggcaacaugagcuuccgggaccuggggcgcgucauggugauggugggcgccacgaugaccgacgacaucgggaugggcgucaccuaccucgcccugcuggcggccuucaaggugcgccccaccuucgccgccggccuccugcugcggaagcucacguccaaggagcugaugaugaccaccaucgggaucguccugcucagccaguccaccauccccgagacgauccuggagcugaccgacgcccucgcgcugggcaugauggugcugaagaucgugcgcaacauggagaaguaccagcucgccgucaccaucauggccauccugugcgugccgaacgccgugauccugcagaacgccuggaaggucagcugcaccauccucgcggugguguccgucagcccccugcugcucacguccagccagcagaaggccgacuggaucccccuggcccugaccaucaaggggcucaaccccaccgccaucuuccugaccacgcugucccggaccagcaagaagcgcuccuggccgcucaacgaggcgaucauggccgugggcauggugagcauccuggccuccagccugcucaagaacgacauccccaugaccggcccccuggucgccgggggccugcucaccgugugcuacgugcugacggggcggagcgccgaccuggagcucgagcgcgcggccgacguccggugggaggagcaggccgagaucuccggcagcucccccauccugagcaucaccaucuccgaggacgggagcauguccaucaagaacgaggaggaggagcagacccugaccauccucauccgcacgggccugcuggugaucagcggccucuucccgguguccauccccaucaccgccgccgcgugguaccugugggaggucaagaagcagcgggccggggugcugugggacgugcccagcccgccgcccgucggcaaggccgagcucgaggacggggccuaccgcaucaagcagaagggcauccugggguacucccagaucggcgccggcguguacaaggaggggaccuuccacaccauguggcacgugacccggggcgcgguccugaugcacaaggggaagcgcaucgagcccagcugggccgacgugaagaaggaccucaucuccuacggcgggggcuggaagcuggagggcgaguggaaggagggggaggaggugcagguccuggcccucgagcccggcaagaacccccgggccgugcagacgaagcccgggcuguucaagaccaacaccggcaccaucggggccgugagccuggacuucucccccggcacgagcggcucccccaucgucgacaagaaggggaagguggugggccucuacgggaacggcgucgugacccgcagcggcaccuacguguccgcgaucgcccagaccgagaaguccaucgaggacaaccccgagaucgaggacgacaucuuccggaagaagcgccugacgaucauggaccugcaccccggggccggcaagaccaagcgguaccugcccgccaucguccgcgaggcgaucaagcgggggcuccgcacccugauccuggccccgacccgggugguggccgccgagauggaggaggcccuccgcggccugcccauccgcuaccagacgcccgcgauccgggccgagcacaccgggcgcgagaucgucgaccugaugugccacgccaccuucaccaugcggcuccugagccccauccgcgugccgaacuacaaccugaucaucauggacgaggcccacuucacggaccccgccuccaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucacggacuucaagggcaagaccgugugguucgugccguccaucaaggccgggaacgacaucgccgccugccuccgcaagaacggcaagaaggucauccagcugagccggaagaccuucgacuccgaguacgugaagacccgcacgaacgacugggacuucguggucaccaccgacaucagcgagaugggcgcgaacuucaaggccgagcgggugaucgacccccgccggugcaugaagcccgugauccugaccgacggggaggagcgcgucauccucgccggccccaugccggugacgcacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucguggaccugaugcgccggggcgaccuccccgucuggcuggccuaccgcguggcggccgaggggaucaacuacgccgaccggcgcuggugcuucgacggcgugaagaacaaccagauccuggaggagaacgucgagguggagaucuggaccaaggagggggagcggaagaagcucaagccgcgcuggcuggacgcccggaucuacagcgacccccuggcccucaaggaguucaaggaguucgcggccggccgcaagucccugacgcugaaccucaucaccgagaugggccggcugcccaccuucaugacccagaaggcccgcaacgcccuggacaaccucgcggugcugcacacggccgaggccgggggccgggccuacaaccacgcccugagcgagcuccccgagacccuggagacccugcuccugcugacccuccuggcgacggucaccgggggcaucuuccuguuccucauguccggcaaggggaucggcaagaugacccuggggaugugcugcaucaucaccgccagcgugcugcucugguacgcccagauccagccgcacuggaucgccgccuccaucauccuggaguucuuccugaucgugcuccugauccccgagcccgagaagcagcgcacgccccaggacaaccagcugacguacgucgugaucgcgauccucaccguggucgccgccaccauggccaacgagaugggcuuccuggagaagaccaagaaggacuucgggcugggcggcaucgccacgcagcagccggagagcaacauccucgacaucgaccugcggcccgcgagcgccuggacccuguacgccguggccaccaccuucaucacgcccaugcuccgccacuccaucgagaacagcuccgugaacgucagccugaccgccaucgcgaaccaggccaccgugcugauggggcucggcaagggguggccccuguccaagauggacaucggcgugccgcugcucgccaucgggugcuacagccaggucaaccccaucacccugacggccgcgcugcuccugcugguggcccacuacgccaucaucggccccggccuccaggccaaggccacccgggaggcgcagaagcgcgccgccgccgggaucaugaagaaccccaccguggacggcaucaccgucaucgaccuggacccgauccccuacgaccccaaguucgagaagcagcugggccaggugaugcuccuggugcugugcgucacccaggugcucaugaugcggaccaccugggcccugugcgaggcgcugacccucgccacgggccccaucuccacccugugggaggggaacccgggccgcuucuggaacaccaccaucgccgugagcauggccaacaucuuccgcggcuccuaccuggccggggcgggccuccuguucagcaucaugaagaacacggccaacacccggcgcgggaccggcaacaccggcgagacgcugggggagaaguggaagaaccggcucaacgcccugggcaaguccgaguuccagaucuacaagaaguccgggauccaggaggucgaccgcacccuggccaaggagggcaucaagcgcggggagaccgaccaccacgcggugucccgcggcagcgccaagcuccggugguucguggagcgcaaccuggucacccccgagggcaaggugauggaccuggggugcggccgcggcgggugguccuacuacugcggcgggcucaagaacgugaaggaggucaaggggcugacgaagggcgggcccgggcacgaggagcccaucccgaugagcaccuacggcuggaaccuggugcgccuccaguccgggguggacgucuucuucacgccgcccgagaagugcgacacccugcugugcgacaucggcgagagcucccccaacccgacgguggaggccggccggacccuccgcgugcugaaccuggucgagaacuggcucaacaacaacacccaguucugcaucaaggugcugaaccccuacaugcccagcgugaucgagaagauggaggcccugcagcggaaguacgggggcgcccugguccgcaacccgcucagccggaacuccacccacgagauguacugggugagcaacgcguccgggaacaucgugagcuccgucaacaugaucagccgcaugcugaucaaccgguucaccaugcgccacaagaaggccacguacgagcccgacguggaccugggcuccgggacccggaacaucggcaucgagagcgagacccccaaccucgacaucaucggcaagcgcaucgagaagaucaagcaggagcacgagaccuccuggcacuacgaccaggaccaccccuacaagacgugggccuaccacgggagcuacgagaccaagcagaccggcuccgccagcuccauggugaacggggucgugcgccugcugaccaagccgugggacgucauccccauggugacgcagauggccaugaccgacaccacccccuucggccagcagcggguguucaaggagaaggucgacacgcgcacccaggagcccaaggagggcaccaagaagcucaugaagaucaccgcggaguggcuguggaaggagcuggggaagaagaagacgccgcggaugugcacccgcgaggaguucacccggaaggugcgcagcaacgccgcccucggcgccaucuucaccgacgagaacaaguggaaguccgcccgggaggcgguggaggacagcggguucugggagcuggucgacaaggagcgcaaccugcaccucgagggcaagugcgagacgugcguguacaacaugauggggaagcgggagaagaagcugggcgaguucggcaaggccaaggggucccgcgccaucugguacauguggcugggcgcccgguuccucgaguucgaggcgcugggguuccugaacgaggaccacugguucagccgcgagaacucccucagcggcguggagggggagggccugcacaagcugggcuacauccuccgggacgucagcaagaaggagggcggggccauguacgccgacgacaccgccgggugggacacccgcaucacccuggaggaccugaagaacgaggagauggugacgaaccacauggagggcgagcacaagaagcucgccgaggcgaucuucaagcugaccuaccagaacaaggugguccgggugcagcgccccaccucccgggggaccgugauggacaucaucagccgccgggaccagcgcggcuccggccaggucgugacguacgggcugaacaccuucaccaacauggaggcccagcucauccggcagauggagggcgaggggguguucaagagcauccagcagcugaccgccacggaggagaucgccgucaagaacuggcuggcccgcgugggccgcgagcggcucucccgcauggcgaucagcggcgacgacugcguggucaagccccuggacgaccgguucgccuccgcccugaccgcccucaacgacauggggaaggugcgcaaggacauccagcagugggagcccagccggggcuggaacgacuggacccaggugccguucugcucccaccacuuccacgagcugaucaugaaggacgggcgcguccugguggugcccugccggaaccaggacgagcucaucggccgcgcccggaucagccagggggcgggcuggucccugcgcgagaccgccugccugggcaagagcuacgcccagauguggucccucauguacuuccaccggcgcgaccugcggcuggccgccaacgcgaucugcagcgccguccccucccacugggugcccacgagccgcaccaccugguccauccacgccacccacgaguggaugaccacggaggacaugcucaccguguggaaccgggucuggauccaggagaacccguggaucgaggacaagacccccguggagagcugggaggagauccccuaccuggggaagcgcgaggaccaguggugcggcagccugaucgggcucaccucccgggccacgugggcgaagaacauccagaccgccaucaaccaggugcgcagccugaucggcaacgaggaguacaccgacuacaugcccuccaugaagcgguuccgccgcgaggaggaggaggccgggguccugugguga

SEQ ID NO: 9787 - RNA, 9876 nt, Artificial Sequence
  derived and/or modified CDS sequence (opt1) from DENV-2__DQ645553__SS-prME
accgccggggugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcguggcccuggucccccacgugggcauggggcuggagacccggaccgagaccuggauguccagcgagggcgccuggaagcacgcccagcggaucgagaccugggugcuccgccaccccggguucacgaucauggcggccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcaugguggaccggggcuggggcaacgggugcggccuguucgggaagggcgggaucgucacgugcgccauguucacgugcaagaagaacauggagggcaagguggugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggaggacaaggccuggcugguccaccggcagugguuccucgaccugccccugcccuggcucccgggcgcggacacccagggguccaacuggauccagaaggagacccuggugacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccccggcgggguguucaccuccaucggcaaggcgcugcaccaggucuucggggccaucuacggcgccgccuucagcggcguguccuggaccaugaagauccugaucgggguggucaucaccuggaucggcaugaacagccgcuccacgagccucuccgugagccuggugcuggucgggguggugacccuguaccucggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcuggccuccgccauccagaaggcccacgaggaggggaucugcggcauccggagcgugacccgccucgagaaccugauguggaagcagaucaccccggagcugaaccacauccucuccgagaacgaggucaagcugaccaucaugacgggggacaucaagggcaucaugcaggccgggaagcggagccugcgcccccagcccaccgagcucaaguacuccuggaaggcguggggcaaggccaagaugcugagcaccgagcugcacaaccacaccuuccucaucgacggcccggagacggccgagugccccaacaccaaccgggccuggaacucccuggagguggaggacuacggguucggcguguucaccaccaacaucuggcugaagcucaaggagcgccaggacgucuucugcgacagcaagcugauguccgccgcgaucaaggacaaccgggccgugcacgccgacaugggguacuggaucgagagcgcccugaacgacacguggaagaucgagaaggccuccuucaucgaggucaagagcugccacuggcccaagucccacacccucuggagcaacggcgugcuggaguccgagaugaucauccccaagaacuucgcgggcccggugagccagcacaacuaccgccccggguaccacacccagaccgccggccccuggcaccuggggaagcucgagauggacuucgacuucugcgagggcaccacgguggucgugaccgaggacugcgggaaccggggccccagccugcgcaccaccacggccuccggcaagcugaucaccgaguggugcugccggagcugcacccucccgccccugcgcuaccgcggggaggacggcugcugguacgggauggagauccgcccccugaaggagaaggaggagaaccucgugaacucccuggucaccgccggccacgggcagaucgacaacuucagccugggcgugcucggcauggcgcuguuccuggaggagaugcuccggacgcgcguggggaccaagcacgccauccugcuggucgccguguccuucgugacccucaucaccggcaacaugagcuuccgggaccuggggcgcgucauggugauggugggcgccacgaugaccgacgacaucgggaugggcgucaccuaccuggcccuccuggcggccuucaaggugcgccccaccuucgccgccggccugcuccugcggaagcugacguccaaggagcucaugaugaccaccaucgggaucguccugcugagccaguccaccaucccggagacgauccucgagcugaccgacgcccuggcgcucggcaugauggugcugaagaucgugcgcaacauggagaaguaccagcuggccgucaccaucauggccauccucugcgugcccaacgccgugauccugcagaacgccuggaaggucagcugcaccauccuggcggugguguccgucagcccccuccugcugacguccagccagcagaaggccgacuggaucccccucgcccugaccaucaaggggcugaacccgaccgccaucuuccucaccacgcugucccggaccagcaagaagcgcuccuggccccugaacgaggcgaucauggccgugggcauggugagcauccucgccuccagccugcugaagaacgacauccccaugaccggcccccucgucgccgggggccugcugaccgugugcuacgugcucacggggcggagcgccgaccuggagcuggagcgcgcggccgacguccggugggaggagcaggccgagaucuccggcagcuccccgauccucagcaucaccaucuccgaggacgggagcauguccaucaagaacgaggaggaggagcagacccugaccauccugauccgcacgggccuccuggugaucagcggccuguuccccguguccauccccaucaccgccgccgcgugguaccucugggaggucaagaagcagcgggccggggugcugugggacgugcccagcccgccgcccgucggcaaggccgagcuggaggacggggccuaccgcaucaagcagaagggcauccucggguacucccagaucggcgccggcguguacaaggaggggaccuuccacaccauguggcacgugacccggggcgcgguccugaugcacaaggggaagcgcaucgagccgagcugggccgacgugaagaaggaccugaucuccuacggcgggggcuggaagcucgagggcgaguggaaggagggggaggaggugcagguccuggcccuggagcccggcaagaacccccgggccgugcagacgaagcccggccuguucaagaccaacaccggcaccaucggggccgugagccuggacuucuccccgggcacgagcggcucccccaucgucgacaagaaggggaagguggugggccuguacgggaacggcgucgugacccgcagcggcaccuacguguccgcgaucgcccagaccgagaaguccaucgaggacaaccccgagaucgaggacgacaucuuccggaagaagcgccucacgaucauggaccugcaccccggggccggcaagaccaagcgguaccugccggccaucguccgcgaggcgaucaagcgggggcugcgcacccucauccuggcccccacccgggugguggccgccgagauggaggaggcccugcgcggccuccccauccgcuaccagacgcccgcgauccgggccgagcacaccgggcgcgagaucgucgaccugaugugccacgccaccuucaccaugcggcugcucagcccgauccgcgugcccaacuacaaccugaucaucauggacgaggcccacuucacggaccccgccuccaucgcggcccggggcuacaucagcacccgcguggagaugggcgaggccgccgggaucuucaugaccgccacgccgcccggcucccgggaccccuucccccagagcaacgcgcccaucauggacgaggagcgcgagauccccgagcgguccuggaacagcgggcacgagugggucacggacuucaagggcaagaccgugugguucgugcccuccaucaaggccgggaacgacaucgccgccugccugcgcaagaacggcaagaaggucauccagcucagccggaagaccuucgacuccgaguacgugaagacccgcacgaacgacugggacuucguggucaccaccgacaucagcgagaugggcgcgaacuucaaggccgagcgggugaucgacccccgccggugcaugaagcccgugauccugaccgacggggaggagcgcgucauccuggccggcccgaugcccgugacgcacuccagcgccgcccagcggcgcgggcgggucggccgcaaccccaagaacgagaacgaccaguacaucuacaugggggagccccucgagaacgacgaggacugcgcgcacuggaaggaggccaagaugcugcuggacaacaucaacaccccggagggcaucauccccuccauguucgagcccgagcgcgagaagguggacgccaucgacggcgaguaccggcuccgcggggaggcccggaagaccuucguggaccugaugcgccggggcgaccugccggucuggcucgccuaccgcguggcggccgaggggaucaacuacgccgaccggcgcuggugcuucgacggcgugaagaacaaccagauccuggaggagaacgucgagguggagaucuggaccaaggagggggagcggaagaagcugaagccccgcuggcucgacgcccggaucuacagcgacccccuggcccugaaggaguucaaggaguucgcggccggccgcaagucccucacgcugaaccugaucaccgagaugggccggcuccccaccuucaugacccagaaggcccgcaacgcccuggacaaccuggcggugcuccacacggccgaggccgggggccgggccuacaaccacgcccugagcgagcugccggagacccucgagacccugcugcuccugacccugcucgcgacggucaccgggggcaucuuccuguuccugauguccggcaaggggaucggcaagaugacccucgggaugugcugcaucaucaccgccagcgugcugcugugguacgcccagauccagccccacuggaucgccgccuccaucauccucgaguucuuccugaucgugcugcucauccccgagcccgagaagcagcgcaccccgcaggacaaccagcugacguacgucgugaucgcgauccugaccguggucgccgccaccauggccaacgagaugggcuuccucgagaagaccaagaaggacuucgggcugggcggcaucgccacgcagcagcccgagagcaacauccuggacaucgaccuccggcccgcgagcgccuggacccuguacgccguggccaccaccuucaucacgcccaugcugcgccacuccaucgagaacagcuccgugaacgucagccucaccgccaucgcgaaccaggccaccgugcugauggggcugggcaagggguggccgcucuccaagauggacaucggcgugccccugcuggccaucgggugcuacagccaggucaaccccaucacccucacggccgcgcugcugcuccugguggcccacuacgccaucaucggccccggccugcaggccaaggccacccgggaggcgcagaagcgcgccgccgccgggaucaugaagaacccgaccguggacggcaucaccgucaucgaccucgaccccauccccuacgaccccaaguucgagaagcagcugggccaggugaugcugcucgugcugugcgucacccaggugcugaugaugcggaccaccugggcccucugcgaggcgcugacccuggccacgggcccgaucuccacccucugggaggggaaccccggccgcuucuggaacaccaccaucgccgugagcauggccaacaucuuccgcggcuccuaccuggccggggcgggccuccucuucagcaucaugaagaacacggccaacacccggcgcgggaccggcaacaccggcgagacgcugggggagaaguggaagaaccggcugaacgcccucggcaaguccgaguuccagaucuacaagaaguccgggauccaggaggucgaccgcacccuggccaaggagggcaucaagcgcggggagaccgaccaccacgcggugucccgcggcagcgccaagcugcggugguucguggagcgcaaccucgucacccccgagggcaaggugauggaccuggggugcggccgcggcgggugguccuacuacugcggcgggcugaagaacgugaaggaggucaaggggcucacgaagggcgggcccgggcacgaggagccgauccccaugagcaccuacggcuggaaccuggugcgccugcaguccgggguggacgucuucuucacgccgcccgagaagugcgacacccuccugugcgacaucggcgagagcuccccgaaccccacgguggaggccggccggacccugcgcgugcucaaccuggucgagaacuggcugaacaacaacacccaguucugcaucaaggugcucaaccccuacaugccgagcgugaucgagaagauggaggcccugcagcggaaguacgggggcgcccugguccgcaacccccugagccggaacuccacccacgagauguacugggugagcaacgcguccgggaacaucgugagcuccgucaacaugaucagccgcaugcucaucaaccgguucaccaugcgccacaagaaggccacguacgagcccgacguggaccugggcuccgggacccggaacaucggcaucgagagcgagacccccaaccuggacaucaucggcaagcgcaucgagaagaucaagcaggagcacgagaccuccuggcacuacgaccaggaccacccguacaagacgugggccuaccacgggagcuacgagaccaagcagaccggcuccgccagcuccauggugaacggggucgugcgccuccugaccaagcccugggacgucauccccauggugacgcagauggccaugaccgacaccacccccuucggccagcagcggguguucaaggagaaggucgacacgcgcacccaggagccgaaggagggcaccaagaagcugaugaagaucaccgcggaguggcucuggaaggagcuggggaagaagaagacgccccggaugugcacccgcgaggaguucacccggaaggugcgcagcaacgccgcccugggcgccaucuucaccgacgagaacaaguggaaguccgcccgggaggcgguggaggacagcggguucugggagcucgucgacaaggagcgcaaccugcaccuggagggcaagugcgagacgugcguguacaacaugauggggaagcgggagaagaagcucggcgaguucggcaaggccaaggggucccgcgccaucugguacauguggcugggcgcccgguuccuggaguucgaggcgcucggguuccugaacgaggaccacugguucagccgcgagaacucccugagcggcguggagggggagggccuccacaagcugggcuacauccugcgggacgucagcaagaaggagggcggggccauguacgccgacgacaccgccgggugggacacccgcaucacccucgaggaccugaagaacgaggagauggugacgaaccacauggagggcgagcacaagaagcuggccgaggcgaucuucaagcucaccuaccagaacaaggugguccgggugcagcgccccacgccccgggggaccgugauggacaucaucucccgccgggaccagcgcggcagcggccaggucgugacguacgggcugaacaccuucaccaacauggaggcccagcugauccggcagauggagggcgaggggguguucaaguccauccagcagcucaccgccacggaggagaucgccgucaagaacuggcuggcccgcgugggccgcgagcggcugagccgcauggcgaucuccggcgacgacugcguggucaagccgcucgacgaccgguucgccagcgcccugaccgcccugaacgacauggggaaggugcgcaaggacauccagcagugggagcccucccggggcuggaacgacuggacccaggugcccuucugcagccaccacuuccacgagcucaucaugaaggacgggcgcguccugguggugcccugccggaaccaggacgagcugaucggccgcgcccggaucucccagggggcgggcuggagccuccgcgagaccgccugccugggcaaguccuacgcccagauguggagccugauguacuuccaccggcgcgaccuccggcuggccgccaacgcgaucugcuccgccgucccgagccacugggugcccacgucccgcaccaccuggagcauccacgccacccacgaguggaugaccacggaggacaugcuggccguguggaaccgggucuggauccaggagaaccccuggaucgaggacaagacccccguggaguccugggaggagaucccguaccucgggaagcgcgaggaccaguggugcggcagccugaucgggcugaccagccgggcgaccugggccaagaacauccagacggccaucaaccaggugcgcucccucaucggcaacgaggaguacaccgacuacaugcccagcaugaagcgguuccgccgcgaggaggaggaggccgggguccugugguga

SEQ ID NO: 9788 - RNA, 9876 nt, Artificial Sequence
  derived and/or modified CDS sequence (opt1) from DENV-2__DQ645554__SS-prME
accgccggcgugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcguggcccuggucccccacgugggcauggggcuggagacccggaccgagaccuggauguccagcgagggcgccuggaagcacgcccagcggaucgagaccugggugcuccgccaccccggguucaccaucauggcggccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcaugguggaccggggcuggggcaacgggugcggccuguucgggaagggcgggaucgucacgugcgccauguucacgugcaagaagaacauggagggcaagguggugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggaggacaaggccuggcugguccaccggcagugguuccucgaccugccccugcccuggcucccgggcgcggacacccagggguccaacuggauccagaaggagacccuggugacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggagguggaggacuacggguucggcguguucaccaccaacaucuggcucaagcugaaggagcgccaggacgucuucugcgacagcaagcugauguccgccgcgaucaaggacaaccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggaagcuggagauggacuucgacuucugcgagggcaccacgguggucgugaccgaggacugcgggaaccggggccccagccugcgcaccaccacggccuccggcaagcucaucaccgaguggugcugccggagcugcacccugcccccgcugcgcuaccgcggggaggacggcugcugguacgggauggagauccgcccccucaaggagaaggaggagaaccuggugaacucccuggucaccgccggccacgggcagaucgacaacuucagccucggcgugcugggcauggcgcuguuccucgaggagaugcugcggacgcgcguggggaccaagcacgccauccugcucgucgccguguccuucgugacccugaucaccggcaacaugagcuuccgggaccuggggcgcgucauggugauggugggcgccacgaugaccgacgacaucgggaugggcgucaccuaccucgcccugcuggcggccuucaaggugcgccccaccuucgccgccggccuccugcugcggaagcucacguccaaggagcugaugaugaccaccaucgggaucguccugcucagccaguccaccauccccgagacgauccuggagcugaccgacgcccucgcgcugggcaugauggugcugaagaucgugcgcaacauggagaaguaccagcucgccgucaccaucauggccauccugugcgugccgaacgccgugauccugcagaacgccuggaaggucagcugcaccauccucgcggugguguccgucagcccccugcugcucacguccagccagcagaaggccgacuggaucccccuggcccugaccaucaaggggcucaaccccaccgccaucuuccugaccacgcugucccggaccagcaagaagcgcuccuggccgcucaacgaggcgaucauggccgugggcauggugagcauccuggccuccagccugcucaagaacgacauccccaugaccggcccccuggucgccgggggccugcucaccgugugcuacgugcugacggggcggagcgccgaccuggagcucgagcgcgcggccgacguccggugggaggagcaggccgagaucuccggcagcucccccauccugagcaucaccaucuccgaggacgggagcauguccaucaagaacgaggaggaggagcagacccugaccauccucauccgcacgggccugcuggugaucagcggccucuucccgguguccauccccaucaccgccgccgcgugguaccugugggaggucaagaagcagcgggccggggugcugugggacgugcccagcccgccgcccgucggcaaggccgagcucgaggacggggccuaccgcaucaagcagaagggcauccugggguacucccagaucggcgccggcguguacaaggaggggaccuuccacaccauguggcacgugacccggggcgcgguccugaugcacaaggggaagcgcaucgagcccagcugggccgacgugaagaaggaccucaucuccuacggcgggggcuggaagcuggagggcgaguggaaggagggggaggaggugcagguccuggcccucgagcccggcaagaacccccgggccgugcagacgaagcccgggcuguucaagaccaacaccggcaccaucggggccgugagccuggacuucucccccggcacgagcggcucccccaucgucgacaagaaggggaagguggugggccucuacgggaacggcgucgugacccgcagcggcaccuacguguccgcgaucgcccagaccgagaaguccaucgaggacaaccccgagaucgaggacgacaucuuccggaagaagcgccugacgaucauggaccugcaccccggggccggcaagaccaagcgguaccugcccgccaucguccgcgaggcgaucaagcgggggcuccgcacccugauccuggccccgacccgggugguggccgccgagauggaggaggcccuccgcggccugcccauccgcuaccagacgcccgcgauccgggccgagcacaccgggcgcgagaucgucgaccugaugugccacgccaccuucaccaugcggcuccugagccccauccgcgugccgaacuacaaccugaucaucauggacgaggcccacuucacggaccccgccuccaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucacggacuucaagggcaagaccgugugguucgugccguccaucaaggccgggaacgacaucgccgccugccuccgcaagaacggcaagaaggucauccagcugagccggaagaccuucgacuccgaguacgugaagacccgcacgaacgacugggacuucguggucaccaccgacaucagcgagaugggcgcgaacuucaaggccgagcgggugaucgacccccgccggugcaugaagcccgugauccugaccgacggggaggagcgcgucauccucgccggccccaugccggugacgcacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucguggaccugaugcgccggggcgaccuccccgucuggcuggccuaccgcguggcggccgaggggaucaacuacgccgaccggcgcuggugcuucgacggcgugaagaacaaccagauccuggaggagaacgucgagguggagaucuggaccaaggagggggagcggaagaagcucaagccgcgcuggcuggacgcccggaucuacagcgacccccuggcccucaaggaguucaaggaguucgcggccggccgcaagucccugacgcugaaccucaucaccgagaugggccggcugcccaccuucaugacccagaaggcccgcaacgcccuggacaaccucgcggugcugcacacggccgaggccgggggccgggccuacaaccacgcccugagcgagcuccccgagacccuggagacccugcuccugcugacccuccuggcgacggucaccgggggcaucuuccuguuccucauguccggcaaggggaucggcaagaugacccuggggaugugcugcaucaucaccgccagcgugcugcucugguacgcccagauccagccgcacuggaucgccgccuccaucauccuggaguucuuccugaucgugcuccugauccccgagcccgagaagcagcgcacgccccaggacaaccagcugacguacgucgugaucgcgauccucaccguggucgccgccaccauggccaacgagaugggcuuccuggagaagaccaagaaggacuucgggcugggcggcaucgccacgcagcagccggagagcaacauccucgacaucgaccugcggcccgcgagcgccuggacccuguacgccguggccaccaccuucaucacgcccaugcuccgccacuccaucgagaacagcuccgugaacgucagccugaccgccaucgcgaaccaggccaccgugcugauggggcucggcaagggguggccccuguccaagauggacaucggcgugccgcugcucgccaucgggugcuacagccaggucaaccccaucacccugacggccgcgcugcuccugcugguggcccacuacgccaucaucggccccggccuccaggccaaggccacccgggaggcgcagaagcgcgccgccgccgggaucaugaagaaccccaccguggacggcaucaccgucaucgaccuggacccgauccccuacgaccccaaguucgagaagcagcugggccaggugaugcuccuggugcugugcgucacccaggugcucaugaugcggaccaccugggcccugugcgaggcgcugacccucgccacgggccccaucuccacccugugggaggggaacccgggccgcuucuggaacaccaccaucgccgugagcauggccaacaucuuccgcggcuccuaccuggccggggcgggccuccuguucagcaucaugaagaacacggccaacacccggcgcgggaccggcaacaccggcgagacgcugggggagaaguggaagaaccggcucaacgcccugggcaaguccgaguuccagaucuacaagaaguccgggauccaggaggucgaccgcacccuggccaaggagggcaucaagcgcggggagaccgaccaccacgcggugucccgcggcagcgccaagcuccggugguucguggagcgcaaccuggucacccccgagggcaaggugauggaccuggggugcggccgcggcgggugguccuacuacugcggcgggcucaagaacgugaaggaggucaaggggcugacgaagggcgggcccgggcacgaggagcccaucccgaugagcaccuacggcuggaaccuggugcgccuccaguccgggguggacgucuucuucacgccgcccgagaagugcgacacccugcugugcgacaucggcgagagcucccccaacccgacgguggaggccggccggacccuccgcgugcugaaccuggucgagaacuggcucaacaacaacacccaguucugcaucaaggugcugaaccccuacaugcccagcgugaucgagaagauggaggcccugcagcggaaguacgggggcgcccugguccgcaacccgcucagccggaacuccacccacgagauguacugggugagcaacgcguccgggaacaucgugagcuccgucaacaugaucagccgcaugcugaucaaccgguucaccaugcgccacaagaaggccacguacgagcccgacguggaccugggcuccgggacccggaacaucggcaucgagagcgagacccccaaccucgacaucaucggcaagcgcaucgagaagaucaagcaggagcacgagaccuccuggcacuacgaccaggaccaccccuacaagacgugggccuaccacgggagcuacgagaccaagcagaccggcuccgccagcuccauggugaacggggucgugcgccugcugaccaagccgugggacgucauccccauggugacgcagauggccaugaccgacaccacccccuucggccagcagcggguguucaaggagaaggucgacacgcgcacccaggagcccaaggagggcaccaagaagcucaugaagaucaccgcggaguggcuguggaaggagcuggggaagaagaagacgccgcggaugugcacccgcgaggaguucacccggaaggugcgcagcaacgccgcccucggcgccaucuucaccgacgagaacaaguggaaguccgcccgggaggcgguggaggacagcggguucugggagcuggucgacaaggagcgcaaccugcaccucgagggcaagugcgagacgugcguguacaacaugauggggaagcgggagaagaagcugggcgaguucggcaaggccaaggggucccgcgccaucugguacauguggcugggcgcccgguuccucgaguucgaggcgcugggguuccugaacgaggaccacugguucagccgcgagaacucccucagcggcguggagggggagggccugcacaagcugggcuacauccuccgggacgucagcaagaaggagggcggggccauguacgccgacgacaccgccgggugggacacccgcaucacccuggaggaccugaagaacgaggagauggugacgaaccacauggagggcgagcacaagaagcucgccgaggcgaucuucaagcugaccuaccagaacaaggugguccgggugcagcgccccacgccccgggggaccgugauggacaucaucucccgccgggaccagcgcggcagcggccaggucgugacguacgggcugaacaccuucaccaacauggaggcccagcucauccggcagauggagggcgaggggguguucaaguccauccagcagcugaccgccacggaggagaucgccgucaagaacuggcuggcccgcgugggccgcgagcggcucagccgcauggcgaucuccggcgacgacugcguggucaagccccuggacgaccgguucgccagcgcccugaccgcccucaacgacauggggaagauccgcaaggacauccagcagugggagccgucccggggcuggaacgacuggacccaggugcccuucugcagccaccacuuccacgagcugaucaugaaggacgggcgcgugcuggucgugcccugccggaaccaggacgagcucaucggccgcgcccggaucucccagggggcgggcuggagccugcgcgagaccgccugccugggcaaguccuacgcccagauguggagccucauguacuuccaccggcgcgaccugcggcuggccgccaacgcgaucugcuccgccgugcccagccacugggucccgacgucccgcaccaccuggagcauccacgccacccacgaguggaugaccacggaggacaugcucaccguguggaaccggguguggauccaggagaaccccuggaucgaggacaagacccccgucgaguccugggaggagauccccuaccuggggaagcgcgaggaccaguggugcggcagccugaucgggcucaccagccgggccacgugggcgaagaacauccagaccgccaucaaccaggugcgcucccugaucggcaacgaggaguacaccgacuacaugccgagcaugaagcgguuccgccgcgaggaggaggaggccggggugcugugguga

SEQ ID NO: 9789 - RNA, 9876 nt, Artificial Sequence
  derived and/or modified CDS sequence (opt1) from DENV-2__DQ645555__SS-prME
accgccggcgugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcguggcccuggucccccacgugggcauggggcuggagacccggaccgagaccuggauguccagccagggcgccuggaagcacgcccagcggaucgagaccugggugcuccgccaccccggguucaccaucauggcggccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcaugguggaccggggcuggggcaacgggugcggccuguucgggaagggcgggaucgucacgugcgccauguucacgugcaagaagaacauggagggcaagguggugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggaggacaaggccuggcugguccaccggcagugguuccucgaccugccccugcccuggcucccgggcgcggacacccagggguccaacuggauccagaaggagacccuggugacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggagguggaggacuacggguucggcguguucaccaccaacaucuggcucaagcugaaggagcgccaggacgucuucugcgacagcaagcugauguccgccgcgaucaaggacaaccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggaagcuggagauggacuucgacuucugcgagggcaccacgguggucgugaccgaggacugcgggaaccggggccccagccugcgcaccaccacggccuccggcaagcucaucaccgaguggugcugccggagcugcacccugcccccgcugcgcuaccgcggggaggacggcugcugguacgggauggagauccgcccccucaaggagaaggaggagaaccuggugaacucccuggucaccgccggccacgggcagaucgacaacuucagccucggcgugcugggcauggcgcuguuccucgaggagaugcugcggacgcgcguggggaccaagcacgccauccugcucgucgccguguccuucgugacccugaucaccggcaacaugagcuuccgggaccuggggcgcgucauggugauggugggcgccacgaugaccgacgacaucgggaugggcgucaccuaccucgcccugcuggcggccuucaaggugcgccccaccuucgccgccggccuccugcugcggaagcucacguccaaggagcugaugaugaccaccaucgggaucguccugcucagccaguccaccauccccgagacgauccuggagcugaccgacgcccucgcgcugggcaugauggugcugaagaucgugcgcaacauggagaaguaccagcucgccgucaccaucauggccauccugugcgugccgaacgccgugauccugcagaacgccuggaaggucagcugcaccauccucgcggugguguccgucagcccccugcugcucacguccagccagcagaaggccgacuggaucccccuggcccugaccaucaaggggcucaaccccaccgccaucuuccugaccacgcugucccggaccagcaagaagcgcuccuggccgcucaacgaggcgaucauggccgugggcauggugagcauccuggccuccagccugcucaagaacgacauccccaugaccggcccccuggucgccgggggccugcucaccgugugcuacgugcugacggggcggagcgccgaccuggagcucgagcgcgcggccgacguccggugggaggagcaggccgagaucuccggcagcucccccauccugagcaucaccaucuccgaggacgggagcauguccaucaagaacgaggaggaggagcagacccugaccauccucauccgcacgggccugcuggugaucagcggccucuucccgguguccauccccaucaccgccgccgcgugguaccugugggaggucaagaagcagcgggccggggugcugugggacgugcccagcccgccgcccgucggcaaggccgagcucgaggacggggccuaccgcaucaagcagaagggcauccugggguacucccagaucggcgccggcguguacaaggaggggaccuuccacaccauguggcacgugacccggggcgcgguccugaugcacaaggggaagcgcaucgagcccagcugggccgacgugaagaaggaccucaucuccuacggcgggggcuggaagcuggagggcgaguggaaggagggggaggaggugcagguccuggcccucgagcccggcaagaacccccgggccgugcagacgaagcccgggcuguucaagaccaacaccggcaccaucggggccgugagccuggacuucucccccggcacgagcggcucccccaucgucgacaagaaggggaagguggugggccucuacgggaacggcgucgugacccgcagcggcaccuacguguccgcgaucgcccagaccgagaaguccaucgaggacaaccccgagaucgaggacgacaucuuccggaagaagcgccugacgaucauggaccugcaccccggggccggcaagaccaagcgguaccugcccgccaucguccgcgaggcgaucaagcgggggcuccgcacccugauccuggccccgacccgggugguggccgccgagauggaggaggcccuccgcggccugcccauccgcuaccagacgcccgcgauccgggccgagcacaccgggcgcgagaucgucgaccugaugugccacgccaccuucaccaugcggcuccugagccccauccgcgugccgaacuacaaccugaucaucauggacgaggcccacuucacggaccccgccuccaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucacggacuucaagggcaagaccgugugguucgugccguccaucaaggccgggaacgacaucgccgccugccuccgcaagaacggcaagaaggucauccagcugagccggaagaccuucgacuccgaguacgugaagacccgcacgaacgacugggacuucguggucaccaccgacaucagcgagaugggcgcgaacuucaaggccgagcgggugaucgacccccgccggugcaugaagcccgugauccugaccgacggggaggagcgcgucauccucgccggccccaugccggugacgcacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucguggaccugaugcgccggggcgaccuccccgucuggcuggccuaccgcguggcggccgaggggaucaacuacgccgaccggcgcuggugcuucgacggcgugaagaacaaccagauccuggaggagaacgucgagguggagaucuggaccaaggagggggagcggaagaagcucaagccgcgcuggcuggacgcccggaucuacagcgacccccuggcccucaaggaguucaaggaguucgcggccggccgcaagucccugacgcugaaccucaucaccgagaugggccggcugcccaccuucaugacccagaaggcccgcaacgcccuggacaaccucgcggugcugcacacggccgaggccgggggccgggccuacaaccacgcccugagcgagcuccccgagacccuggagacccugcuccugcugacccuccuggcgacggucaccgggggcaucuuccuguuccucauguccggcaaggggaucggcaagaugacccuggggaugugcugcaucaucaccgccagcgugcugcucugguacgcccagauccagccgcacuggaucgccgccuccaucauccuggaguucuuccugaucgugcuccugauccccgagcccgagaagcagcgcacgccccaggacaaccagcugacguacgucgugaucgcgauccucaccguggucgccgccaccauggccaacgagaugggcuuccuggagaagaccaagaaggacuucgggcugggcggcaucgccacgcagcagccggagagcaacauccucgacaucgaccugcggcccgcgagcgccuggacccuguacgccguggccaccaccuucaucacgcccaugcuccgccacuccaucgagaacagcuccgugaacgucagccugaccgccaucgcgaaccaggccaccgugcugauggggcucggcaagggguggccccuguccaagauggacaucggcgugccgcugcucgccaucgggugcuacagccaggucaaccccaucacccugacggccgcgcugcuccugcugguggcccacuacgccaucaucggccccggccuccaggccaaggccacccgggaggcgcagaagcgcgccgccgccgggaucaugaagaaccccaccguggacggcaucaccgucaucgaccuggacccgauccccuacgaccccaaguucgagaagcagcugggccaggugaugcuccuggugcugugcgucacccaggugcucaugaugcggaccaccugggcccugugcgaggcgcugacccucgccacgggccccaucuccacccugugggaggggaacccgggccgcuucuggaacaccaccaucgccgugagcauggccaacaucuuccgcggcuccuaccuggccggggcgggccuccuguucagcaucaugaagaacacggccaacacccggcgcgggaccggcaacaccggcgagacgcugggggagaaguggaagaaccggcucaacgcccugggcaaguccgaguuccagaucuacaagaaguccgggauccaggaggucgaccgcacccuggccaaggagggcaucaagcgcggggagaccgaccaccacgcggugucccgcggcagcgccaagcuccggugguucguggagcgcaaccuggucacccccgagggcaaggugauggaccuggggugcggccgcggcgggugguccuacuacugcggcgggcucaagaacgugaaggaggucaaggggcugacgaagggcgggcccgggcacgaggagcccaucccgaugagcaccuacggcuggaaccuggugcgccuccaguccgggguggacgucuucuucacgccgcccgagaagugcgacacccugcugugcgacaucggcgagagcucccccaacccgacgguggaggccggccggacccuccgcgugcugaaccuggucgagaacuggcucaacaacaacacccaguucugcaucaaggugcugaaccccuacaugcccagcgugaucgagaagauggaggcccugcagcggaaguacgggggcgcccugguccgcaacccgcucagccggaacuccacccacgagauguacugggugagcaacgcguccgggaacaucgugagcuccgucaacaugaucagccgcaugcugaucaaccgguucaccaugcgccacaagaaggccacguacgagcccgacguggaccugggcuccgggacccggaacaucggcaucgagagcgagacccccaaccucgacaucaucggcaagcgcaucgagaagaucaagcaggagcacgagaccuccuggcacuacgaccaggaccaccccuacaagacgugggccuaccacgggagcuacgagaccaagcagaccggcuccgccagcuccauggugaacggggucgugcgccugcugaccaagccgugggacgucauccccauggugacgcagauggccaugaccgacaccacccccuucggccagcagcggguguucaaggagaaggucgacacgcgcacccaggagcccaaggagggcaccaagaagcucaugaagaucaccgcggaguggcuguggaaggagcuggggaagaagaagacgccgcggaugugcacccgcgaggaguucacccggaaggugcgcagcaacgccgcccucggcgccaucuucaccgacgagaacaaguggaaguccgcccgggaggcgguggaggacagcggguucugggagcuggucgacaaggagcgcaaccugcaccucgagggcaagugcgagacgugcguguacaacaugauggggaagcgggagaagaagcugggcgaguucggcaaggccaaggggucccgcgccaucugguacauguggcugggcgcccgguuccucgaguucgaggcgcugggguuccugaacgaggaccacugguucagccgcgagaacucccucagcggcguggagggggagggccugcacaagcugggcuacauccuccgggacgucagcaagaaggagggcggggccauguacgccgacgacaccgccgggugggacacccgcaucacccuggaggaccugaagaacgaggagauggugacgaaccacauggagggcgagcacaagaagcucgccgaggcgaucuucaagcugaccuaccagaacaaggugguccgggugcagcgccccacgccccgggggaccgugauggacaucaucucccgccgggaccagcgcggcagcggccaggucgugacguacgggcugaacaccuucaccaacauggaggcccagcucauccggcagauggagggcgaggggguguucaaguccauccagcagcugaccgccacggaggagaucgccgucaagaacuggcuggcccgcgugggccgcgagcggcucagccgcauggcgaucuccggcgacgacugcguggucaagccccuggacgaccgguucgccagcgcccugaccgcccucaacgacauggggaaggugcgcaaggacauccagcagugggagccgucccggggcuggaacgacuggacccaggugcccuucugcagccaccacuuccacgagcugaucaugaaggacgggcgcguccugguggugcccugccggaaccaggacgagcucaucggccgcgcccggaucucccagggggcgggcuggagccugcgcgagaccgccugccugggcaaguccuacgcccagauguggagccucauguacuuccaccggcgcgaccugcggcuggccgccaacgcgaucugcuccgccguccccagccacugggugccgacgucccgcaccaccuggagcauccacgccacccacgaguggaugaccacggaggacaugcucaccguguggaaccgggucuggauccaggagaaccccuggaucgaggacaagacccccguggaguccugggaggagauccccuaccuggggaagcgcgaggaccaguggugcggcagccugaucgggcucaccagccgggccacgugggcgaagaacauccagaccgccaucaaccaggugcgcucccugaucggcaacgaggaguacaccgacuacaugccgagcaugaagcgguuccgccgcgaggaggaggaggccgggguccugugguga

SEQ ID NO: 9790 - RNA, 9876 nt, Artificial Sequence
  derived and/or modified CDS sequence (opt1) from DENV-2__DQ645556__SS-prME
accgccggcgugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcguggcccuggucccccacgugggcauggggcuggagacccggaccgagaccuggauguccagcgagggcgccuggaagcacgcccagcggaucgagaccugggugcuccgccaccccggguucaccaucauggcggccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaucaagaccgaggccaagcaccccgccacccugcgcaaguacugcaucgaggccaagcucaccaacacgaccaccgcgagccggugcccgacccagggggagcccucccugaacgaggagcaggacaagcgcuucgugugcaagcacagcaugguggaccggggcuggggcaacgggugcggccuguucgggaagggcgggaucgucacgugcgccauguucacgugcaagaagaacauggagggcaagguggugcagcccgagaaccucgaguacaccaucgucaucacgccccacuccggcgaggagaacgccguggggaacgacacgggcaagcacgggaaggagaucaaggugaccccgcagagcuccaucaccgaggccgagcugaccggcuacgggaccgucacgauggagugcagcccccgcaccggccuggacuucaacgagauggugcuccugcagauggaggacaaggccuggcugguccaccggcagugguuccucgaccugccccugcccuggcucccgggcgcggacacccagggguccaacuggauccagaaggagacccuggugacguucaagaacccccacgccaagaagcaggacguggucgugcugggcagccaggagggggccaugcacaccgcccucaccggcgccaccgagauccagaugagcuccgggaaccugcuguucacgggccaccucaagugccgccugcggauggacaagcugcagcucaagggcaugagcuacuccaugugcaccgggaaguucaagguggucaaggagaucgcggagacccagcacggcaccaucgugauccgcgugcaguacgagggggacggcagccccugcaagauccccuucgagaucauggaccuggagaagcggcacguccugggccgccucaucacggugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccaccaugcgcggcgccaagcggauggccauccucggcgacacggccugggacuucgggagccugggcgggguguucaccuccaucggcaaggcgcugcaccaggucuucggggccaucuacggcgccgccuucagcggcguguccuggaccaugaagauccucaucgggguggucaucaccuggaucggcaugaacagccgcuccacgagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacaccuggacggagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugaccaucaugacgggggacaucaagggcaucaugcaggccgggaagcggagccuccgcccgcagcccaccgagcugaaguacuccuggaaggcguggggcaaggccaagaugcugagcaccgagcuccacaaccacaccuuccugaucgacggccccgagacggccgagugcccgaacaccaaccgggccuggaacucccuggagguggaggacuacggguucggcguguucaccaccaacaucuggcucaagcugaaggagcgccaggacgucuucugcgacagcaagcugauguccgccgcgaucaaggacaaccgggccgugcacgccgacaugggguacuggaucgagagcgcccucaacgacacguggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggaagcuggagauggacuucgacuucugcgagggcaccacgguggucgugaccgaggacugcgggaaccggggccccagccugcgcaccaccacggccuccggcaagcucaucaccgaguggugcugccggagcugcacccugcccccgcugcgcuaccgcggggaggacggcugcugguacgggauggagauccgcccccucaaggagaaggaggagaaccuggugaacucccuggucaccgccggccacgggcagaucgacaacuucagccucggcgugcugggcauggcgcuguuccucgaggagaugcugcggacgcgcguggggaccaagcacgccauccugcucgucgccguguccuucgugacccugaucaccggcaacaugagcuuccgggaccuggggcgcgucauggugauggugggcgccacgaugaccgacgacaucgggaugggcgucaccuaccucgcccugcuggcggccuucaaggugcgccccaccuucgccgccggccuccugcugcggaagcucacguccaaggagcugaugaugaccaccaucgggaucguccugcucagccaguccaccauccccgagacgauccuggagcugaccgacgcccucgcgcugggcaugauggugcugaagaucgugcgcaacauggagaaguaccagcucgccgucaccaucauggccauccugugcgugccgaacgccgugauccugcagaacgccuggaaggucagcugcaccauccucgcggugguguccgucagcccccugcugcucacguccagccagcagaaggccgacuggaucccccuggcccugaccaucaaggggcucaaccccaccgccaucuuccugaccacgcugucccggaccagcaagaagcgcuccuggccgcucaacgaggcgaucauggccgugggcauggugagcauccuggccuccagccugcucaagaacgacauccccaugaccggcccccuggucgccgggggccugcucaccgugugcuacgugcugacggggcggagcgccgaccuggagcucgagcgcgcggccgacguccggugggaggagcaggccgagaucuccggcagcucccccauccugagcaucaccaucuccgaggacgggagcauguccaucaagaacgaggaggaggagcagacccugaccauccucauccgcacgggccugcuggugaucagcggccucuucccgguguccauccccaucaccgccgccgcgugguaccugugggaggucaagaagcagcgggccggggugcugugggacgugcccagcccgccgcccgucggcaaggccgagcucgaggacggggccuaccgcaucaagcagaagggcauccugggguacucccagaucggcgccggcguguacaaggaggggaccuuccacaccauguggcacgugacccggggcgcgguccugaugcacaaggggaagcgcaucgagcccagcugggccgacgugaagaaggaccucaucuccuacggcgggggcuggaagcuggagggcgaguggaaggagggggaggaggugcagguccuggcccucgagcccggcaagaacccccgggccgugcagacgaagcccgggcuguucaagaccaacaccggcaccaucggggccgugagccuggacuucucccccggcacgagcggcucccccaucgucgacaagaaggggaagguggugggccucuacgggaacggcgucgugacccgcagcggcaccuacguguccgcgaucgcccagaccgagaaguccaucgaggacaaccccgagaucgaggacgacaucuuccggaagaagcgccugacgaucauggaccugcaccccggggccggcaagaccaagcgguaccugcccgccaucguccgcgaggcgaucaagcgggggcuccgcacccugauccuggccccgacccgggugguggccgccgagauggaggaggcccuccgcggccugcccauccgcuaccagacgcccgcgauccgggccgagcacaccgggcgcgagaucgucgaccugaugugccacgccaccuucaccaugcggcuccugagccccauccgcgugccgaacuacaaccugaucaucauggacgaggcccacuucacggaccccgccuccaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucacggacuucaagggcaagaccgugugguucgugccguccaucaaggccgggaacgacaucgccgccugccuccgcaagaacggcaagaaggucauccagcugagccggaagaccuucgacuccgaguacgugaagacccgcacgaacgacugggacuucguggucaccaccgacaucagcgagaugggcgcgaacuucaaggccgagcgggugaucgacccccgccggugcaugaagcccgugauccugaccgacggggaggagcgcgucauccucgccggccccaugccggugacgcacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucguggaccugaugcgccggggcgaccuccccgucuggcuggccuaccgcguggcggccgaggggaucaacuacgccgaccggcgcuggugcuucgacggcgugaagaacaaccagauccuggaggagaacgucgagguggagaucuggaccaaggagggggagcggaagaagcucaagccgcgcuggcuggacgcccggaucuacagcgacccccuggcccucaaggaguucaaggaguucgcggccggccgcaagucccugacgcugaaccucaucaccgagaugggccggcugcccaccuucaugacccagaaggcccgcaacgcccuggacaaccucgcggugcugcacacggccgaggccgggggccgggccuacaaccacgcccugagcgagcuccccgagacccuggagacccugcuccugcugacccuccuggcgacggucaccgggggcaucuuccuguuccucauguccggcaaggggaucggcaagaugacccuggggaugugcugcaucaucaccgccagcgugcugcucugguacgcccagauccagccgcacuggaucgccgccuccaucauccuggaguucuuccugaucgugcuccugauccccgagcccgagaagcagcgcacgccccaggacaaccagcugacguacgucgugaucgcgauccucaccguggucgccgccaccauggccaacgagaugggcuuccuggagaagaccaagaaggacuucgggcugggcggcaucgccacgcagcagccggagagcaacauccucgacaucgaccugcggcccgcgagcgccuggacccuguacgccguggccaccaccuucaucacgcccaugcuccgccacuccaucgagaacagcuccgugaacgucagccugaccgccaucgcgaaccaggccaccgugcugauggggcucggcaagggguggccccuguccaagauggacaucggcgugccgcugcucgccaucgggugcuacagccaggucaaccccaucacccugacggccgcgcugcuccugcugguggcccacuacgccaucaucggccccggccuccaggccaaggccacccgggaggcgcagaagcgcgccgccgccgggaucaugaagaaccccaccguggacggcaucaccgucaucgaccuggacccgauccccuacgaccccaaguucgagaagcagcugggccaggugaugcuccuggugcugugcgucacccaggugcucaugaugcggaccaccugggcccugugcgaggcgcugacccucgccacgggccccaucuccacccugugggaggggaacccgggccgcuucuggaacaccaccaucgccgugagcauggccaacaucuuccgcggcuccuaccuggccggggcgggccuccuguucagcaucaugaagaacacggccaacacccggcgcgggaccggcaacaccggcgagacgcugggggagaaguggaagaaccggcucaacgcccugggcaaguccgaguuccagaucuacaagaaguccgggauccaggaggucgaccgcacccuggccaaggagggcaucaagcgcggggagaccgaccaccacgcggugucccgcggcagcgccaagcuccggugguucguggagcgcaaccuggucacccccgagggcaaggugauggaccuggggugcggccgcggcgggugguccuacuacugcggcgggcucaagaacgugaaggaggucaaggggcugacgaagggcgggcccgggcacgaggagcccaucccgaugagcaccuacggcuggaaccuggugcgccuccaguccgggguggacgucuucuucacgccgcccgagaagugcgacacccugcugugcgacaucggcgagagcucccccaacccgacgguggaggccggccggacccuccgcgugcugaaccuggucgagaacuggcucaacaacaacacccaguucugcaucaaggugcugaaccccuacaugcccagcgugaucgagaagauggaggcccugcagcggaaguacgggggcgcccugguccgcaacccgcucagccggaacuccacccacgagauguacugggugagcaacgcguccgggaacaucgugagcuccgucaacaugaucagccgcaugcugaucaaccgguucaccaugcgccacaagaaggccacguacgagcccgacguggaccugggcuccgggacccggaacaucggcaucgagagcgagacccccaaccucgacaucaucggcaagcgcaucgagaagaucaagcaggagcacgagaccuccuggcacuacgaccaggaccaccccuacaagacgugggccuaccacgggagcuacgagaccaagcagaccggcuccgccagcuccauggugaacggggucgugcgccugcugaccaagccgugggacgucauccccauggugacgcagauggccaugaccgacaccacccccuucggccagcagcggguguucaaggagaaggucgacacgcgcacccaggagcccaaggagggcaccaagaagcucaugaagaucaccgcggaguggcuguggaaggagcuggggaagaagaagacgccgcggaugugcacccgcgaggaguucacccggaaggugcgcagcaacgccgcccucggcgccaucuucaccgacgagaacaaguggaaguccgcccgggaggcgguggaggacagcggguucugggagcuggucgacaaggagcgcaaccugcaccucgagggcaagugcgagacgugcguguacaacaugauggggaagcgggagaagaagcugggcgaguucggcaaggccaaggggucccgcgccaucugguacauguggcugggcgcccgguuccucgaguucgaggcgcugggguuccugaacgaggaccacugguucagccgcgagaacucccucagcggcguggagggggagggccugcacaagcugggcuacauccuccgggacgucagcaagaaggagggcggggccauguacgccgacgacaccgccgggugggacacccgcaucacccuggaggaccugaagaacgaggagauggugacgaaccacauggagggcgagcacaagaagcucgccgaggcgaucuucaagcugaccuaccagaacaaggugguccgggugcagcgccccacgccccgggggaccgugauggacaucaucucccgccgggaccagcgcggcagcggccaggucgugacguacgggcugaacaccuucaccaacauggaggcccagcucauccggcagauggagggcgaggggguguucaagaacauccagcagcugaccgccacggaggagaucgccgucaagaacuggcuggcccgcgugggccgcgagcggcucucccgcauggcgaucagcggcgacgacugcguggucaagccccuggacgaccgguucgccuccgcccugaccgcccucaacgacauggggaaggugcgcaaggacgugcagcagugggagccgagccggggcuggaacgacuggacccagguccccuucugcucccaccacuuccacgagcugaucaugaaggacgggcgcgugcuggugguccccugccggaaccaggacgagcucaucggccgcgcccggaucagccagggggcgggcuggucccugcgcgagaccgccugccugggcaagagcuacgcccagauguggucccucauguacuuccaccggcgcgaccugcggcuggccgccaacgcgaucugcagcgccgugcccucccacugggugccgacgagccgcaccaccugguccauccacgccacccacgaguggaugaccacggaggacaugcucaccgucuggaaccggguguggauccaggagaaccccuggaucgaggacaagacccccguggagagcugggaggagauccccuaccuggggaagcgcgaggaccaguggugcggcucccugaucgggcucaccagccgggccacgugggcgaagaacauccagaccgccaucaaccagguccgcagccugaucggcaacgaggaguacaccgacuacaugccguccaugaagcgguuccgccgcgaggaggaggaggccggggugcugugguga

SEQ ID NO: 9791 - RNA, 9876 nt, Artificial Sequence
  derived and/or modified CDS sequence (opt1) from DENV-2__AF204178__SS-prME
accgccggcaugaucaucaugcugauccccaccgugauggccuuccaccucaccacccggaacggggagccccacaugaucgucagccggcaggagaagggcaagagccugcuguucaagaccggggacggcgugaacaugugcacccucauggcgauggaccccggggagcugugcgaggacaccaucaccuacaagugcccccugcucaagcagaacgagcccgaggacaucgacugguggugcaacagcaccuccaccugggugaccuacgggaccugcaccaccaccggcgagcaccggcgggagaagcgcagcgucgcccuggugccgcacguggggaugggccuggagacccggaccgagaccuggauguccagcgagggggccuggaagcacgcccagcggaucgagacguggauccuccggcaccccggcuucaccaugauggccgcgauccuggccuacaccaucgggaccacgcacuuccagcgcgcccugaucuucauccuccugaccgccgucgcgcccuccaugaccaugcggugcaucggcaucagcaaccgcgacuucguggagggcguguccgggggcagcugggucgacaucgugcuggagcacggguccugcgugaccacgauggccaagaacaagcccacccucgacuucgagcugaucaagaccgaggccaagcagccggccacccugcggaaguacugcaucgaggccaagcucacgaacaccaccaccgacagccgcugccccacgcagggcgagcccucccugaacgaggagcaggacaagcgguucgucugcaagcacagcaugguggaccgcggcugggggaacggcugcgggcuguucggcaagggcgggaucgugaccuucgcgauguucacgugcaagaagaacaugaagggcaaggucgugcagcccgagaaccucgaguacaccaucgugaucacgccgcacuccggggaggagcacgccgucggcaacgacaccgggaagcacggcaaggagaucaagaucacgccccagagcuccaucaccgaggccgagcugaccggguacggcacggugaccaugaagugcagcccccggaccggccuggacuucaacgagauggugcuccugcagauggagaacaaggccuggcugguccaccgccagugguuccucgaccugccccugccguggcuccccggggccgacacccagggcuccaacuggauccagaaggagacgcuggugaccuucaagaacccccacgcgaagaagcaggacguggucgugcuggggagccaggagggcgccaugcacaccgcccucaccggggccacggagauccagaugagcuccggcaaccugcuguucaccggccaccucaagugccggcugcgcauggacaagcugcagcucaaggggaugagcuacuccaugugcaccggcaaguucaaggucgugaaggagaucgccgagacccagcacgggacgaucgugauccggguccaguacgagggcgacggcagccccugcaagaucccguucgagaucauggaccuggagaagcgccacgugcuggggcggcucaucaccgugaaccccaucgucaccgagaaggacucccccgugaacaucgaggcggagcccccguucggcgacagcuacaucaucaucgggguggagcccggccagcugaagcugaacugguucaagaagggguccagcaucggccagauguucgagaccacgaugcgcggcgccaagcgcauggccauccucggggacaccgccugggacuucggcucccucggcggggucuucaccagcaucgggaaggcccugcaccagguguucggggcgaucuacggcgccgccuucuccggggugagcuggaccaugaagauccucaucggcgucaucaucacguggaucgggaugaacucccggagcaccucccugagcgugucccuggugcuggucggcguggugacccucuaccugggggucauggugcaggccgacagcggcugcguggucuccuggaagaacaaggagcugaagugcggcagcgggaucuucaucaccgacgacgugcacacguggaccgagcaguacaaguuccagcccgagagccccuccaagcucgcgagcgccauccagaaggcccacgaggagggcaucugcgggauccgcuccgugacccggcuggagaaccugauguggaagcagaucaccccggagcucaaccacauccugagcgagaacgaggucaagcugacgaucaugaccggcgacaucaaggggaucaugcaggccggcaagcgcucccuccggccccagcccaccgagcugaaguacagcuggaagaccuggggcaaggccaagaugcuguccacggagagccacaaccagaccuuccucaucgacgggccggagaccgcggagugccccaacaccaaccgcgccuggaacucccuggagguggaggacuacggcuucgggguguucacgaccaacaucuggcugaagcuccgggagaagcaggacgucuucugcgacagcaagcugauguccgccgugaucaaggacaaccgcgccgcccacgcggacaugggcuacuggaucgagagcgcccugaacgacaccuggaagaucgagaaggccuccuucaucgaggucaagagcugccacuggcccaagucccacacccucuggagcaacggcgugcuggaguccgagaugaucauccccaagaacuucgccgggccggugagccagcacaacuaccggcccggcuaccacacccagacggccgggcccuggcaccugggcaagcucgagauggacuucgacuucugcgaggggaccaccguggucgugaccgaggacugcggcaaccgcggccccagccugcggacgaccaccgcguccgggaagcugaucaccgaguggugcugccgcagcugcacgcucccgccccugcgguaccgcggcgaggacgggugcugguacggcauggagauccggccccugaaggagaaggaggagaaccucgugaacucccuggucaccgccgggcacggccagaucgacaacuucagccugggcgugcucgggauggcccuguuccuggaggagaugcuccgcacccgggugggcaccaagcacgccauccugcuggucgcgguguccuucgugacgcucaucaccgggaacaugagcuuccgcgaccugggccgggucauggugauggugggggccaccaugaccgacgacaucggcaugggcgucacguaccuggcccuccuggccgccuucaaggugcgccccaccuucgcggccgggcugcuccugcgcaagcugaccuccaaggagcucaugaugaccacgaucggcaucgugcugcugagccaguccaccaucccggagaccauccucgagcugaccgacgcccuggcccucgggaugaugguccugaagauggugcggaagauggagaaguaccagcuggccgugacgaucauggcgauccucugcguccccaacgccgugauccugcagaacgccuggaaggucagcugcaccauccuggccgugguguccgucagcccccucuucaucaccuccagccagcagaaggccgacuggaucccccuggcgcugaccaucaagggccucaacccgacggccaucuuccugaccacccugucccgcaccaacaagaagcggagcuggccccucaacgaggccaucauggccgugggcaugguguccauccuggcgagcucccugcucaagaacgacauccccaugacggggccccuggucgccggcgggcugcucaccgugugcuacgugcugaccggccgcagcgccgaccuggagcucgagcgggccgccgacgucaagugggaggaccaggcggagaucagcggguccagcccgauccuguccaucaccaucagcgaggacggcuccaugagcaucaagaacgaggaggaggagcagauccugacgauccucauccgcaccggccugcuggugaucuccgggcuguuccccgugagcauccccaucaccgccgccgccugguaccugugggaggucaagaagcagcgggccggcgugcugugggacgugcccuccccgccgcccgucgggaaggcggagcucgaggacggcgccuaccgcaucaagcagaaggggauccugggcuacagccagaucggcgccgggguguacaaggagggcaccuuccacaccauguggcacgugacgcgcggggccguccugaugcacaagggcaagcgcaucgagccguccugggccgacgugaagaaggaccucaucagcuacgggggcggcuggaagcuggagggggaguggaaggagggcgaggaggugcagguccuggcgcucgagcccgggaagaacccccgggccgugcagaccaagcccggccuguucaagaccaacgccgggaccaucggcgccgugucccuggacuucagcccgggcacguccgggagccccaucaucgacaagaagggcaaggucguggggcucuacggcaacggcguggucacccgcuccggggccuacgugagcgcgaucgcccagaccgagaaguccaucgaggacaaccccgagaucgaggacgacaucuuccggaagcgcaagcugaccaucauggaccugcaccccggcgccgggaagacgaagcgguaccucccggccaucgugcgcgaggcgaucaagcggggccugcgcacccugauccuggcccccacccgggucguggccgccgagauggaggaggcccuccgcgggcugcccauccgguaccagacccccgcgauccgcgccgagcacacgggccgcgagaucguggaccugaugugccacgccaccuucaccaugcggcuccugagcccgguccgcgugcccaacuacaaccugaucaucauggacgaggcccacuucaccgaccccgccagcaucgcggcccggggcuacaucuccacgcgcguggagaugggggaggccgccggcaucuucaugaccgccacgccgcccgggagccgggaccccuucccccaguccaacgcgcccaucauggacgaggagcgcgagauccccgagcggagcugguccagcggccacgagugggucaccgacuucaaggggaagacggugugguucgugcccuccaucaaggccggcaacgacaucgccgccugccuccgcaagaacggcaagaaggucauccagcugagccggaagaccuucgacuccgaguacgugaagacccgcaccaacgacugggacuucguggucacgaccgacaucagcgagaugggggcgaacuucaaggccgagcgggugaucgacccccgccggugcaugaagcccgugauccugaccgacggcgaggagcgcgucauccucgccgggccgaugcccgugacccacuccagcgccgcccagcggcgcggccggaucgggcgcaaccccaagaacgagaacgaccaguacaucuacaugggcgagccccuggagaacgacgaggacugcgcgcacuggaaggaggccaagaugcugcucgacaacaucaacacgccggagggcaucauccccuccauguucgagcccgagcgggagaagguggacgccaucgacggggaguaccgccugcgcggcgaggcccggaagaccuucgucgaccugaugcgccgcggggaccucccgguguggcuggccuaccgcguggcggccgagggcaucaacuacgccgaccggcgcuggugcuucgacgggaucaagaacaaccagauccuggaggagaacgucgagguggagaucuggaccaaggagggcgagcggaagaagcucaagccccgcuggcuggacgccaagaucuacagcgacccccuggcccucaaggaguucaaggaguucgcggccggccggaagucccugacccugaaccucaucacggagauggggcgccugcccaccuucaugacccagaaggcccgggacgcccuggacaaccucgcgguccugcacaccgccgaggccggcgggcgcgccuacaaccacgcccugagcgagcucccggagacgcuggagacccugcuccugcugacccuccuggcgaccgugacgggcggcaucuuccuguuccucauguccgggcggggcaucgggaagaugacccugggcaugugcugcaucaucaccgccagcauccugcucugguacgcccagauccagccccacuggaucgccgccuccaucauccuggaguucuuccugaucgugcuccugauccccgagcccgagaagcagcgcaccccgcaggacaaccagcugaccuacgucgugaucgcgauccucacgguggucgccgccaccauggccaacgagaugggguuccuggagaagaccaagaaggaccugggccucggcagcaucaccacgcagcagcccgagagcaacauccuggacaucgaccugcggcccgccuccgcguggacccucuacgccguggccaccaccuucgugacgcccaugcugcgccacagcaucgagaacuccagcgucaacgugucccugaccgccaucgccaaccaggcgaccgugcucauggggcugggcaagggguggccgcugagcaagauggacaucggcgucccccuccuggccaucgggugcuacucccaggugaaccccaucacccugacggccgcccucuuccugcugguggcgcacuacgccaucaucggccccggccuccaggccaaggccacccgggaggcccagaagcgcgcggccgccgggaucaugaagaacccgaccgucgacggcaucaccgugaucgaccuggaccccauccccuacgaccccaaguucgagaagcagcugggccaggugaugcuccugguccugugcgugacccaggugcucaugaugcggaccaccugggcccugugcgaggcccugacccucgcgacgggcccgaucagcacccugugggaggggaaccccggccgcuucuggaacaccaccaucgccgucuccauggccaacaucuuccggggcagcuaccuggccggggccggccuccuguucuccaucaugaagaacacgaccaacacccgccgcgggaccggcaacaucggcgagacgcugggggagaaguggaagauccggcucaacgcgcugggcaagagcgaguuccagaucuacaagaaguccgggauccaggagguggaccgcacccuggccaaggagggcaucaagcgcggggagaccgaccaccacgccgugagccgcggcuccgccaagcuccggugguucgucgagcgcaacauggugacccccgagggcaagguggucgaccuggggugcggccgcggcggguggagcuacuacugcggcgggcugaagaacgugcgcgaggugaaggggcucacgaagggcggccccgggcacgaggagccgauccccauguccaccuacggcuggaaccugguccggcugcagagcgggguggacguguucuucacgccgcccgagaagugcgacacccuccugugcgacaucggcgaguccagcccgaaccccacggucgaggcgggccgcacccugcgggugcucaaccugguggagaacuggcugaacaacaacacccaguucugcaucaagguccucaaccccuacaugccgagcgugaucgagaagauggagacccugcagcgcaaguacgggggcgcccugguggggaacccccucucccggaacagcacccacgagauguacugggucuccaacgccagcggcaacaucguguccagcgugaacaugaucucccgcaugcugaucaaccgguucacgaugcgccacaagaaggccaccuacgagcccgacgucgaccuggggagcggcacccggaacaucggcaucgaguccgagauccccaaccuggacaucaucgggaagcgcaucgagaagaucaagcaggagcacgagaccagcuggcacuacgaccaggaccacccguacaagacgugggccuaccacggcuccuacgagaccaagcagaccgggagcgcguccagcauggugaacggcgugguccggcuccugaccaagcccugggacguggugcccauggucacgcagauggccaugaccgacaccacccccuucggccagcagcgcguguucaaggagaagguggacacgcgcacccaggagccgaaggaggggaccaagaagcugaugaagaucaccgccgaguggcucuggaaggagcugggcaagaagaagacgccccggaugugcacccgcgaggaguucacccggaagguccgcuccaacgccgcccugggggcgaucuucaccgacgagaacaaguggaaguccgcccgggaggccguggaggacucccgcuucugggagcucgucgacaaggagcggaaccugcaccuggagggcaagugcgagacgugcguguacaacaugauggggaagcgcgagaagaagcucggcgaguucggcaaggccaaggggagccgggccaucugguacauguggcugggcgcgcgcuuccuggaguucgaggcccucggguuccugaacgaggaccacugguucucccgggagaacagccugagcggcguggagggggagggccucuacaagcugggcuacauccugcgcgacgucuccaagaaggagggcggcgccauguacgccgacgacaccgcggggugggacacccggaucacccucgaggaccugaagaacgaggagauggugacgaaccacauggagggcgagcacaagaagcuggccgaggccaucuucaagcucaccuaccagaacaaggugguccgcgugcagcggcccacgccccgggggaccgugauggacaucaucagccggcgcgaccagcggggcuccggccaggucgggacguacggccugaacaccuucaccaacauggaggcccagcugauccgccagauggagggggagggcguguucaagagcauccagcaccucaccgugacggaggagaucgccguccagaacuggcuggcgcgggugcgccgcgagcggcugucccgcauggccaucagcggcgacgacugcguggucaagccgcucgacgaccgguucgccuccgcccugaccgcccugaacgacauggggaaggugcgcaaggacauccagcagugggagcccagccggggcuggaacgacuggacccaggugcccuucugcucccaccacuuccacgagcucaucaugaaggacgggcgcguccugguggugcccugccggaaccaggacgagcugaucggccgcgcgcggaucagccagggggccggcuggucccuccgcgagaccgccugccugggcaagagcuacgcccagauguggucccugauguacuuccaccggcgcgaccuccggcuggccgcgaacgccaucugcagcgccgucccgucccacugggugcccacgagccgcaccaccugguccauccacgccaagcacgaguggaugaccaccgaggacaugcugacgguguggaaccgggucuggauccaggagaaccccuggauggaggacaagacccccguggagagcugggaggagaucccguaccucgggaagcgcgaggaccaguggugcggcagccugaucgggcugaccucccgggccaccugggcgaagaacauccagacggccaucaaccaggugcgcagccucaucggcaacgaggaguacaccgacuacaugcccuccaugaagcgguuccgccgcgaggaggaggaggccgggguccugugguga

SEQ ID NO: 9792 - RNA, 9876 nt, Artificial Sequence
  derived and/or modified CDS sequence (opt1) from DENV-2__AF204177__SS-prME
accgcgggcaugaucaucaugcugauccccaccgugauggccuuccaccucaccacccggaacggggagccccacaugaucgucagccggcaggagaagggcaagagccugcuguucaagaccggggacggcgugaacaugugcacccucauggcgauggaccugggggagcugugcgaggacaccaucaccuacaagugcccccuccugcgccagaacgagcccgaggacaucgacugcuggugcaacagcaccagcaccugggugaccuacgggaccugcaccaccaccggcgagcaccggcgcgagaagcggagcgucgcccuggugccccacguggggaugggccucgagacccgcaccgagaccuggauguccagcgagggggccuggaagcacgcccagcggaucgagacguggauccugcgccaccccggcuucaccaucauggccgcgauccuggccuacaccaucgggaccacgcacuuccagcgggcccucaucuucauccugcugaccgccgucgcgcccuccaugaccaugcgcugcaucggcaucagcaaccgggacuucguggagggcguguccgggggcagcugggucgacaucgugcucgagcacggguccugcgugaccacgauggccaagaacaagcccacccuggaccuggagcucaucaagaccgaggccaagcagagcgccacccugcgcaaguacugcaucgaggccaagcugacgaacaccaccaccgagucccggugccccacgcagggcgagcccagccucaacgaggagcaggacaagcgcuucgucugcaagcacuccaugguggaccggggcugggggaacggcugcgggcuguucggcaagggcgggaucgugaccugcgcgauguucacgugcaagaagaacaugaagggcaaggucgugcagcccgagaaccuggaguacaccaucgugaucacgccccacagcggggaggagcacgccgucggcaacgacaccgggaagcacggcaaggagaucaagaucacgccccaguccagcaucaccgaggccgagcucaccggguacggcacggugaccauggagugcuccccgcgcaccggccuggacuucaacgagauggugcugcuccagauggagaacaaggccuggcugguccaccggcagugguuccuggaccucccccugcccuggcugcccggggccgacacccagggcagcaacuggauccagaaggagacgcucgugaccuucaagaacccgcacgcgaagaagcaggacguggucgugcuggggagccaggagggcgccaugcacaccgcccugaccggggccacggagauccagauguccagcggcaaccuccuguucaccggccaccugaagugccgccuccggauggacaagcugcagcugaaggggauguccuacagcaugugcaccggcaaguucaaggucgugaaggagaucgccgagacccagcacgggacgaucgugauccgcguccaguacgagggcgacggcucccccugcaagauccccuucgagaucauggaccucgagaagcggcacgugcuggggcgccugaucaccgugaaccccaucgucaccgagaaggacagcccggugaacaucgaggcggagccgcccuucggcgacuccuacaucaucaucgggguggagcccggccagcucaagcugaacugguucaagaaggggagcuccaucggccagauguucgagaccacgaugcgcggcgccaagcggauggccauccugggggacaccgccugggacuucggcagccucgggggcgucuucaccuccaucgggaaggcccugcaccagguguucggcgcgaucuacggcgccgccuucagcgggguguccuggaccaugaagauccugaucggcgucaucaucacguggaucgggaugaacagccgcuccaccagccuguccgugagccucgugcuggucggcguggugacccuguaccucggggucauggugcaggccgacuccggcugcguggucagcuggaagaacaaggagcugaagugcggcagcgggaucuucaucaccgacaacgugcacacguggaccgagcaguacaaguuccagccggagucccccagcaagcuggcguccgccauccagaaggcccacgaggagggcaucugcgggauccggagcgugacccgccucgagaaccugauguggaagcagaucacccccgagcugaaccacauccucuccgagaacgaggucaagcugacgaucaugaccggcgacaucaaggggaucaugcaggccggcaagcggagccugcgcccccagccgaccgagcucaaguacuccuggaagaccuggggcaaggccaagaugcugagcacggagucccacaaccagaccuuccugaucgacgggcccgagaccgcggagugccccaacaccaaccgggccuggaacagccucgagguggaggacuacggcuucgggguguucacgaccaacaucuggcugaagcugcgcgagaagcaggacgucuucugcgacuccaagcucaugagcgccgccaucaaggacaaccgggccgugcacgcggacaugggcuacuggaucgaguccgcccugaacgacaccuggaagaucgagaaggccagcuucaucgaggugaaguccugccacuggcccaagagccacacccugugguccaacgagguccucgagagcgagaugaucauccccaagaacuucgccggccccgugagccagcacaacuaccgccccggguaccacacccagacggccggcccguggcaccuggggaagcuggagauggacuucgacuucugcgagggcaccaccguggucgugaccgaggacugcgggaaccggggccccucccuccgcacgaccaccgcgagcggcaagcugaucaccgagugcugcugccgguccugcacgcugccgccccuccgcuaccgcggggaggacggcugcugguacgggauggagauccgcccgcugaaggagaaggaggagaaccuggugaacagccucgucaccgccggccacgggcagaucgacaacuucucccugggcgugcugggcauggcccucuuccuggaggagaugcugcggacccgcguggggaccaagcacgccauccuccuggucgcggugagcuucgugacgcugaucaccggcaacauguccuuccgggaccucgggcgcgucauggugauggugggcgccaccaugaccgacgacaucgggaugggcgucacguaccuggcccugcucgccgccuucaaggugcgccccaccuucgcggccggccugcugcuccggaagcugaccagcaaggagcugaugaugaccacgaucgggaucgugcuccugucccagagcaccauccccgagaccauccuggagcucaccgacgcccuggcccugggcaugaugguccucaagauggugcgcaagauggagaaguaccagcuggccgugacgaucauggcgauccugugcguccccaacgccgugauccuccagaacgccuggaaggucuccugcaccauccuggccguggugagcgucuccccgcuguuccucaccagcucccagcagaaggccgacuggaucccccuggcgcugaccaucaaggggcucaaccccacggccaucuuccugaccacccugagcaagaccaacaagaagcgguccuggccccucaacgaggccaucauggccgugggcauggugagcauccuggcguccagccugcucaagaacgacaucccgaugacgggcccccuggucgccgggggccugcucaccgugugcuacgugcugaccgggcgcagcgccgaccuggagcucgagcgggccgccgacgucaagugggaggaccaggcggagaucuccggcagcucccccauccugagcaucaccaucuccgaggacgggagcauguccaucaagaacgaggaggaggagcagauccugacgauccucauccgcaccggccugcuggugaucagcggccucuuccccguguccaucccgaucaccgccgccgccugguaccugugggaggucaagaagcagcgggccggggugcugugggacgugcccuccccgccgcccgucggcaaggcggagcucgaggacggggccuaccgcaucaagcagaagggcauccugggguacucccagaucggcgccggcguguacaaggaggggaccuuccacaccauguggcacgugacgcggggcgccguccugaugcacaaggggaagcgcaucgagcccagcugggccgacgugaagaaggaccucaucuccuacgcgggcggguggaagcuggagggcgaguggaaggagggcgaggaggugcagguccuggcccucgagcccgggaagaacccgcgggccgugcagaccaagcccggccuguucaagaccaacgccgggaccaucggcgccgugagccuggacuucucccccgggacgagcggcucccccaucaucgacaagaagggcaaggucguggggcucuacggcaacgggguggucacccgcagcggcgcguacguguccgccaucgcccagaccgagaaguccaucgaggacaacccggagaucgaggacgacaucuuccggaagcgcaagcugaccaucauggaccugcaccccggcgccgggaagacgaagcgguaccugcccgcgaucgugcgcgaggccaucaagcggggccuccgcacccugauccuggcccccacccgggucguggccgccgagauggaggaggcgcuccgcgggcugccgauccgguaccagacccccgccauccgcgccgagcacacgggccgcgagaucguggaccugaugugccacgccaccuucaccaugcggcuccugagccccguccgcgugcccaacuacaaccugaucaucauggacgaggcccacuucaccgacccggcguccaucgccgcccggggguacaucagcacgcgcguggagaugggcgaggccgccggcaucuucaugaccgcgacgccgcccgggucccgggaccccuucccgcagagcaacgcccccaucauggacgaggagcgcgagauccccgagcgguccuggagcuccggccacgagugggucaccgacuucaaggggaagacggugugguucgugcccagcaucaaggccggcaacgacaucgccgcgugccuccgcaagaacgggaagaaggucauccagcugucccggaagaccuucgacagcgaguacgugaagacccgcaccaacgacugggacuucguggucacgaccgacaucuccgagaugggcgccaacuucaaggccgagcgggugaucgacccgcgccggugcaugaagcccgugauccugaccgacggcgaggagcgcgucauccucgccgggcccaugcccgugacccacagcuccgccgcgcagcggcgcggccggaucgggcgcaacccgaagaacgagaacgaccaguacaucuacaugggcgagccccuggagaacgacgaggacugcgcccacuggaaggaggccaagaugcugcucgacaacaucaacacgcccgaggggaucauccccagcauguucgagccggagcgggagaagguggacgccaucgacggcgaguaccgccugcgcggcgaggcccggaagaccuucgucgaccugaugcgccgcggggaccuccccguguggcuggcguaccgcguggccgccgagggcaucaacuacgccgaccggcgcuggugcuucgacgggaucaagaacaaccagauccuggaggagaacgucgagguggagaucuggaccaaggagggcgagcggaagaagcucaagccccgcuggcuggacgcccggaucuacuccgacccgcuggcgcucaaggaguucaaggaguucgccgccgggcgcaagagccugacccugaaccucaucacggagaugggccggcugcccaccuucaugacccagaaggcccgcgacgcgcuggacaaccucgccguccugcacaccgccgaggccggcgggcgggccuacaaccacgcgcuguccgagcuccccgagacgcuggagacccugcuccugcugacccuccuggccaccgugacgggcgggaucuuccuguuccucaugagcggccgcggcaucgggaagaugacccugggcaugugcugcaucaucaccgccuccauccugcucugguacgcccagauccagccccacuggaucgccgcgagcaucauccuggaguucuuccugaucgugcuccugaucccggagcccgagaagcagcggacgccccaggacaaccagcugaccuacgucgugaucgccauccucacgguggucgccgccaccauggccaacgagaugggguuccuggagaagaccaagaaggaccugggccucgggagcaucaccacgcagcagcccgaguccaacauccuggacaucgaccugcgcccggcgagcgccuggacccucuacgccguggccaccaccuucgugacgcccaugcugcggcacuccaucgagaacagcuccgucaacgugagccugaccgccaucgcgaaccaggccaccgugcucaugggccugggcaagggguggccccuguccaagauggacaucggcgucccccuccuggccaucgggugcuacagccaggugaacccgaucacccugacggccgcccucuuccugcugguggcccacuacgccaucaucggccccgggcuccaggccaaggccacccgcgaggcgcagaagcgggccgccgccggcaucaugaagaaccccaccgucgacggcaucaccgugaucgaccuggaccccaucccguacgaccccaaguucgagaagcagcugggccaggugaugcuccugguccugugcgugacccaggugcucaugaugcgcaccaccugggcccugugcgaggcgcugacccucgccacgggccccaucuccacccugugggaggggaaccccggccgguucuggaacaccaccaucgccgucagcauggccaacaucuuccgcggguccuaccuggccggcgcgggccuccuguucagcaucaugaagaacacgaccaacacccgccgggggaccggcaacaucggggagacgcugggcgagaaguggaagucccgccucaacgcccugggcaagagcgaguuccagaucuacaagaaguccgggauccaggagguggaccggacccuggccaaggagggcaucaagcgcggggagaccgaccaccacgccgugagccggggcuccgcgaagcuccgcugguucgucgagcggaacauggugaccccggaggggaagguggucgaccugggcugcggccgcgggggcuggagcuacuacugcgggggccugaagaacgugcgggaggugaaggggcucacgaagcgcggccccggccacgaggagcccauccccauguccaccuacggguggaaccugguccggcugcagagcggcguggacguguucuucaccccgcccgagaagugcgacacccuccugugcgacaucggggagagcucccccaaccccacggucgaggccggccgcacccugcgggugcucaaccugguggagaacuggcugaacaacaacacccaguucugcaucaagguccucaacccguacaugcccagcgugaucgagaagauggaggcccugcagcgcaaguacgggggcgcccuggugcggaacccccugucccgcaacagcacccacgagauguacugggucuccaacgccagcggcaacaucguguccagcgugaacaugaucucccggaugcucaucaaccgcuucaccaugcggcacaagaaggcgacguacgagccggacgucgaccuggggagcggcacccgcaacaucgggaucgaguccgagauccccaaccuggacaucaucggcaagcgcaucgagaagaucaagcaggagcacgagacccucuggcacuacgaccaggaccaccccuacaagaccugggccuaccacgggagcuacgagacgaagcagaccggcuccgccagcuccauggugaacggcgugguccggcugcugaccaagcccugggacguggugccgauggucacccagauggccaugacggacaccacccccuucgggcagcagcgcguguucaaggagaagguggacacccggacgcaggagcccaaggagggcaccaagaagcucaugaagaucaccgccgaguggcuguggaaggagcuggggaagaagaagacgccccggaugugcacgcgggaggaguucacccgcaagguccggagcaacgcggcccucggcgccaucuucaccgacgagaacaagcgcaaguccgcccgggaggccguggaggacagccgcuucugggagcuggucgacaaggagcggaaccugcaccucgagggcaagugcgagaccugcguguacaacaugauggggaagcgcgagaagaagcugggcgaguucgggaaggcgaagggcucccgggccaucugguacauguggcugggggcccgcuuccucgaguucgaggcccugggcuuccugaacgaggaccacugguucagccgggagaacagccucuccggcguggagggggagggccugcacaagcugggguacauccuccgcgacgucagcaagaaggagggcggggcgauguacgccgacgacacggccggcugggacacccggaucacccuggaggaccugaagaacgaggagauggugaccaaccacauggagggcgagcacaagaagcucgccgaggccaucuucaagcugacguaccagaacaaggugguccgcgugcagcggccgacgccccgcgggaccgugauggacaucaucucccggcgcgaccagcgcggcagcgggcaggucggcaccuacgggcugaacaccuucaccaacauggaggcgcagcucauccggcagauggagggcgagggcguguucaaguccauccagcaccugaccgugaccgaggagaucgccguccagaacuggcuggcccgcguggggcgggagcgccucagccggauggccaucuccggcgacgacugcguggucaagccccuggacgaccgcuucgccagcgcgcugacggcccucaacgacauggggaaggugcggaaggacauccagcagugggagcccucccgcggcuggaacgacuggacccaggugccguucugcagccaccacuuccacgagcugaucaugaaggacggccggguccugguggugcccugccgcaaccagaacgagcucaucgggcgggcccgcaucucccagggcgccggguggagccugcgggagaccgccugccugggcaaguccuacgcgcagauguggagccucauguacuuccaccgccgggaccugcgccuggccgccaacgccaucugcuccgccguccccagccacugggugcccaccucccggacgaccuggagcauccacgcgaagcacgaguggaugaccaccgaggacaugcucaccguguggaaccgcgucuggauccaggagaacccguggauggaggacaagacgagcguggaguccugggaggagauccccuaccuggggaagcgggaggaccaguggugcggcagccugaucggccucaccucccgcgccaccugggccaagaacauccagaccgccaucaaccaggugcgcagccugaucgggaacgaggaguacacggacuacaugcccuccaugaagcgguuccgccgggaggaggaggaggcgggcguccugugguga

SEQ ID NO: 9793 - RNA, 9876 nt, Artificial Sequence
  derived and/or modified CDS sequence (opt1) from DENV-2__DQ645540__SS-prME
accgccggcgugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcguggcccuggucccccacgugggcauggggcuggagacgcggaccgagaccuggauguccagcgagggcgccuggaagcacgcccagcggaucgagaccugggugcuccgccaccccggguucacgaucauggcggccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaccaagaccgaggccaagcaccccgccacccugcgcaaguacugcaucgaggccaagcucacgaacaccaccaccgcgagccggugcccgacgcagggggagcccucccugaacgaggagcaggacaagcgcuucgugugcaagcacagcaugguggaccggggcuggggcaacgggugcggccuguucgggaagggcgggaucgugaccugcgccauguucacgugcaagaagaacauggagggcaagguggugcagcccgagaaccucgaguacaccaucgucaucacgccccacuccggcgaggagaacgccguggggaacgacaccggcaagcacgggaaggagaucaaggugaccccgcagagcuccaucaccgaggccgagcugaccggcuacgggacggucaccauggagugcagcccccgcaccggccuggacuucaacgagauggugcuccugcagauggaggacaaggccuggcugguccaccggcagugguuccucgaccugccccugcccuggcucccgggcgcggacacccagggguccaacuggauccagaaggagacgcuggugaccuucaagaacccccacgccaagaagcaggacguggucgugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaagguggucaaggagaucgcggagacccagcacggcacgaucgugauccgcgugcaguacgagggggacggcagccccugcaagauccccuucgagaucauggaccuggagaagcggcacguccugggccgccucaucaccgugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccacgaugcgcggcgccaagcggauggccauccucggcgacaccgccugggacuucgggagccugggcgggguguucaccuccaucggcaaggcgcugcaccaggucuucggggccaucuacggcgccgccuucagcggcguguccuggaccaugaagauccucaucgggguggucaucacguggaucggcaugaacagccgcuccaccagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacacguggaccgagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugacgaucaugaccggggacaucaagggcaucaugcaggccgggaagcggagccuccgcccgcagcccaccgagcugaaguacuccuggaaggcguggggcaaggccaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuucugcgacagcaagcugauguccgccgcgaucaaggacaaccgggccgugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggaagcuggagauggacuucgacuucugcgagggcacgaccguggucgugaccgaggacugcgggaaccggggccccagccugcgcaccacgaccgccuccggcaagcucaucaccgaguggugcugccggagcugcacccugcccccgcugcgcuaccgcggggaggacggcugcugguacgggauggagauccgcccccucaaggagaaggaggagaaccuggugaacucccuggucacggccggccacgggcagaucgacaacuucagccucggcgugcugggcauggcgcuguuccucgaggagaugcugcggacccgcguggggaccaagcacgccauccugcucgucgccguguccuucgugacccugaucacgggcaacaugagcuuccgggaccuggggcgcgucauggugauggugggcgccaccaugaccgacgacaucgggaugggcgucaccuaccucgcccugcuggcggccuucaaggugcgccccacguucgccgccggccuccugcugcggaagcucaccuccaaggagcugaugaugaccaccaucgggaucguccugcucagccaguccacgauccccgagaccauccuggagcugaccgacgcccucgcgcugggcaugauggugcugaagaucgugcgcaacauggagaaguaccagcucgccgucaccaucauggccauccugugcgugccgaacgccgugauccugcagaacgccuggaaggucagcugcacgauccucgcggugguguccgucagcccccugcugcucaccuccagccagcagaaggccgacuggaucccccuggcccugaccaucaaggggcucaaccccaccgccaucuuccugacgacccugucccggaccagcaagaagcgcuccuggccgcucaacgaggcgaucauggccgugggcauggugagcauccuggccuccagccugcucaagaacgacauccccaugaccggcccccuggucgccgggggccugcucacggugugcuacgugcugaccgggcggagcgccgaccuggagcucgagcgcgcggccgacguccggugggaggagcaggccgagaucuccggcagcucccccauccugagcaucaccaucuccgaggacgggagcauguccaucaagaacgaggaggaggagcagacccugacgauccucauccgcaccggccugcuggugaucagcggccucuucccgguguccauccccaucaccgccgccgcgugguaccugugggaggucaagaagcagcgggccggggugcugugggacgugcccagcccgccgcccgucggcaaggccgagcucgaggacggggccuaccgcaucaagcagaagggcauccugggguacucccagaucggcgccggcguguacaaggaggggaccuuccacaccauguggcacgugacgcggggcgcgguccugaugcacaaggggaagcgcaucgagcccagcugggccgacgugaagaaggaccucaucuccuacggcgggggcuggaagcuggagggcgaguggaaggagggggaggaggugcagguccuggcccucgagcccggcaagaacccccgggccgugcagaccaagcccgggcuguucaagaccaacaccggcacgaucggggccgugagccuggacuucucccccggcaccagcggcucccccaucgucgacaagaaggggaagguggugggccucuacgggaacggcgucgugacccgcagcggcaccuacguguccgcgaucgcccagacggagaaguccaucgaggacaaccccgagaucgaggacgacaucuuccggaagaagcgccugaccaucauggaccugcaccccggggccggcaagaccaagcgguaccugcccgccaucguccgcgaggcgaucaagcgggggcuccgcacccugauccuggccccgacgcgggugguggccgccgagauggaggaggcccuccgcggccugcccauccgcuaccagacccccgcgauccgggccgagcacaccgggcgcgagaucgucgaccugaugugccacgccaccuucacgaugcggcuccugagccccauccgcgugccgaacuacaaccugaucaucauggacgaggcccacuucaccgaccccgccuccaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucaccgacuucaagggcaagaccgugugguucgugccguccaucaaggccgggaacgacaucgccgccugccuccgcaagaacggcaagaaggucauccagcugagccggaagaccuucgacuccgaguacgugaagacgcgcaccaacgacugggacuucguggucaccaccgacaucagcgagaugggcgcgaacuucaaggccgagcgggugaucgacccccgccggugcaugaagcccgugauccugacggacggggaggagcgcgucauccucgccggccccaugccggugacccacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucguggaccugaugcgccggggcgaccuccccgucuggcuggccuaccgcguggcggccgaggggaucaacuacgccgaccggcgcuggugcuucgacggcgugaagaacaaccagauccuggaggagaacgucgagguggagaucuggacgaaggagggggagcggaagaagcucaagccgcgcuggcuggacgcccggaucuacagcgacccccuggcccucaaggaguucaaggaguucgcggccggccgcaagucccugacccugaaccucaucaccgagaugggccggcugcccaccuucaugacgcagaaggcccgcaacgcccuggacaaccucgcggugcugcacaccgccgaggccgggggccgggccuacaaccacgcccugagcgagcuccccgagacccuggagacccugcuccugcugacgcuccuggcgaccgucaccgggggcaucuuccuguuccucauguccggcaaggggaucggcaagaugacccuggggaugugcugcaucaucaccgccagcgugcugcucugguacgcccagauccagccgcacuggaucgccgccuccaucauccuggaguucuuccugaucgugcuccugauccccgagcccgagaagcagcgcacgccccaggacaaccagcugaccuacgucgugaucgcgauccucaccguggucgccgccaccauggccaacgagaugggcuuccuggagaagacgaagaaggacuucgggcugggcggcaucgccacccagcagccggagagcaacauccucgacaucgaccugcggcccgcgagcgccuggacccuguacgccguggccaccacguucaucacccccaugcuccgccacuccaucgagaacagcuccgugaacgucagccugaccgccaucgcgaaccaggccaccgugcugauggggcucggcaagggguggccccuguccaagauggacaucggcgugccgcugcucgccaucgggugcuacagccaggucaaccccaucacgcugaccgccgcgcugcuccugcugguggcccacuacgccaucaucggccccggccuccaggccaaggccacccgggaggcgcagaagcgcgccgccgccgggaucaugaagaaccccaccguggacggcaucacggucaucgaccuggacccgauccccuacgaccccaaguucgagaagcagcuggggcaggucaugcuccuggugcugugcgucacccaggugcucaugaugcggaccaccugggcccugugcgaggcgcugacgcucgccaccggccccaucuccacccugugggaggggaacccgggccgcuucuggaacaccacgaucgccgugagcauggccaacaucuuccgcggcuccuaccuggccggggcgggccuccuguucagcaucaugaagaacaccgccaacacccggcgcgggaccggcaacacgggcgagacccugggggagaaguggaagaaccggcucaacgcccugggcaaguccgaguuccagaucuacaagaaguccgggauccaggaggucgaccgcacccuggccaaggagggcaucaagcgcggggagaccgaccaccacgcggugucccgcggcagcgccaagcuccggugguucguggagcgcaaccuggucacgcccgagggcaaggugauggaccuggggugcggccgcggcgggugguccuacuacugcggcgggcucaagaacgugaaggaggucaaggggcugaccaagggcgggcccgggcacgaggagcccaucccgaugagcaccuacggcuggaaccuggugcgccuccaguccgggguggacgucuucuucacgccgcccgagaagugcgacacgcugcugugcgacaucggcgagagcucccccaacccgaccguggaggccggccggacccuccgcgugcugaaccuggucgagaacuggcucaacaacaacacccaguucugcaucaaggugcugaaccccuacaugcccagcgugaucgagaagauggaggcccugcagcggaaguacgggggcgcccugguccgcaacccgcucagccggaacuccacccacgagauguacugggugagcaacgcguccgggaacaucgugagcuccgucaacaugaucagccgcaugcugaucaaccgguucacgaugcgccacaagaaggccaccuacgagcccgacguggaccugggcuccgggacccggaacaucggcaucgagagcgagauccccaaccucgacaucaucggcaagcgcaucgagaagaucaagcaggagcacgagaccuccuggcacuacgaccaggaccaccccuacaagacgugggccuaccacgggagcuacgagaccaagcagaccggcuccgccagcuccauggugaacggggucgugcgccugcugaccaagccgugggacgucauccccauggugacgcagauggccaugaccgacaccacccccuucggccagcagcggguguucaaggucaagguggacacgcgcacccaggagcccaaggagggcaccaagaagcucaugaagaucaccgcggaguggcuguggaaggagcuggggaagaagaagacgccgcggaugugcacccgcgaggaguucacccggaaggugcgcagcaacgccgcccucggcgccaucuucaccgacgagaacaaguggaaguccgcccgggaggcggucgaggacagcggguucugggagcugguggacaaggagcgcaaccugcaccucgagggcaagugcgagacgugcguguacaacaugauggggaagcgggagaagaagcugggcgaguucggcaaggccaaggggucccgcgccaucugguacauguggcugggcgcccgguuccucgaguucgaggcgcugggguuccugaacgaggaccacugguucagccgcgagaacucccucagcggcgucgagggggagggccugcacaagcugggcuacauccuccgggacgugagcaagaaggagggcggcgccauguacgccgacgacaccgccgggugggacacccgcaucacccuggaggaccugaagaacgaggagauggugacgaaccacauggagggcgagcacaagaagcucgccgaggcgaucuucaagcugaccuaccagaacaaggucgugcgggugcagcgccccacgccccgggggaccgucauggacaucaucucccgccgggaccagcgcggcagcggccagguggugacguacgggcugaacaccuucaccaacauggaggcccagcucauccggcagauggagggcgagggggucuucaaguccauccagcagcugaccgccacggaggagaucgccgugaagaacuggcuggcccgcgugggccgcgagcggcucagccgcauggcgaucuccggcgacgacugcgucgugaagccccuggacgaccgguucgccagcgcccugaccgcccucaacgacauggggaaggugcgcaaggacauccagcagugggagccgucccggggcuggaacgacuggacccagguccccuucugcagccaccacuuccacgagcugaucaugaaggacgggcgcgugcuggugguccccugccggaaccaggacgagcucaucggccgcgcccggaucucccagggggcgggcuggagccugcgcgagaccgccugccugggcaaguccuacgcccagauguggagccucauguacuuccaccggcgcgaccugcggcuggccgccaacgcgaucugcuccgccgugcccagccacugggugccgacgucccgcaccaccuggagcauccacgccacccacgaguggaugaccacggaggacaugcucaccgucuggaaccggguguggauccaggagaaccccuggaucgaggacaagacccccguggaguccugggaggagauccccuaccuggggaagcgcgaggaccaguggugcggcagccugaucgggcucaccagccgggccacgugggcgaagaacauccagaccgccaucaaccagguccgcucccugaucggcaacgaggaguacaccgacuacaugccgagcaugaagcgguuccgccgcgaggaggaggaggccggggugcugugguga

SEQ ID NO: 9794 - RNA, 9876 nt, Artificial Sequence
  derived and/or modified CDS sequence (opt1) from DENV-2__DQ645541__SS-prME
accgccggcgugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcguggcccuggucccccacgugggcauggggcuggagacgcggaccgagaccuggauguccagcgagggcgccuggaagcacgcccagcggaucgagaccugggugcuccgccaccccggguucacgaucauggcggccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaccaagaccgaggccaagcaccccgccacccugcgcaaguacugcaucgaggccaagcucacgaacaccaccaccgcgagccggugcccgacgcagggggagcccucccugaacgaggagcaggacaagcgcuucgugugcaagcacagcaugguggaccggggcuggggcaacgggugcggccuguucgggaagggcgggaucgugaccugcgccauguucacgugcaagaagaacauggagggcaagguggugcagcccgagaaccucgaguacaccaucgucaucacgccccacuccggcgaggagaacgccguggggaacgacaccggcaagcacgggaaggagaucaaggugaccccgcagagcuccaucaccgaggccgagcugaccggcuacgggacggucaccauggagugcagcccccgcaccggccuggacuucaacgagauggugcuccugcagauggaggacaaggccuggcugguccaccggcagugguuccucgaccugccccugcccuggcucccgggcgcggacacccagggguccaacuggauccagaaggagacgcuggugaccuucaagaacccccacgccaagaagcaggacguggucgugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaagguggucaaggagaucgcggagacccagcacggcacgaucgugauccgcgugcaguacgagggggacggcagccccugcaagauccccuucgagaucauggaccuggagaagcggcacguccugggccgccucaucaccgugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccacgaugcgcggcgccaagcggauggccauccucggcgacaccgccugggacuucgggagccugggcgggguguucaccuccaucggcaaggcgcugcaccaggucuucggggccaucuacggcgccgccuucagcggcguguccuggaccaugaagauccucaucgggguggucaucacguggaucggcaugaacagccgcuccaccagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacacguggaccgagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugacgaucaugaccggggacaucaagggcaucaugcaggccgggaagcggagccuccgcccgcagcccaccgagcugaaguacuccuggaaggcguggggcaaggccaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuucugcgacagcaagcugauguccgccgcgaucaaggacaaccgggccgugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggaagcuggagauggacuucgacuucugcgagggcacgaccguggucgugaccgaggacugcgggaaccggggccccagccugcgcaccacgaccgccuccggcaagcucaucaccgaguggugcugccggagcugcacccugcccccgcugcgcuaccgcggggaggacggcugcugguacgggauggagauccgcccccucaaggagaaggaggagaaccuggugaacucccuggucacggccggccacgggcagaucgacaacuucagccucggcgugcugggcauggcgcuguuccucgaggagaugcugcggacccgcguggggaccaagcacgccauccugcucgucgccguguccuucgugacccugaucacgggcaacaugagcuuccgggaccuggggcgcgucauggugauggugggcgccaccaugaccgacgacaucgggaugggcgucaccuaccucgcccugcuggcggccuucaaggugcgccccacguucgccgccggccuccugcugcggaagcucaccuccaaggagcugaugaugaccaccaucgggaucguccugcucagccaguccacgauccccgagaccauccuggagcugaccgacgcccucgcgcugggcaugauggugcugaagaucgugcgcaacauggagaaguaccagcucgccgucaccaucauggccauccugugcgugccgaacgccgugauccugcagaacgccuggaaggucagcugcacgauccucgcggugguguccgucagcccccugcugcucaccuccagccagcagaaggccgacuggaucccccuggcccugaccaucaaggggcucaaccccaccgccaucuuccugacgacccugucccggaccagcaagaagcgcuccuggccgcucaacgaggcgaucauggccgugggcauggugagcauccuggccuccagccugcucaagaacgacauccccaugaccggcccccuggucgccgggggccugcucacggugugcuacgugcugaccgggcggagcgccgaccuggagcucgagcgcgcggccgacguccggugggaggagcaggccgagaucuccggcagcucccccauccugagcaucaccaucuccgaggacgggagcauguccaucaagaacgaggaggaggagcagacccugacgauccucauccgcaccggccugcuggugaucagcggccucuucccgguguccauccccaucaccgccgccgcgugguaccugugggaggucaagaagcagcgggccggggugcugugggacgugcccagcccgccgcccgucggcaaggccgagcucgaggacggggccuaccgcaucaagcagaagggcauccugggguacucccagaucggcgccggcguguacaaggaggggaccuuccacaccauguggcacgugacgcggggcgcgguccugaugcacaaggggaagcgcaucgagcccagcugggccgacgugaagaaggaccucaucuccuacggcgggggcuggaagcuggagggcgaguggaaggagggggaggaggugcagguccuggcccucgagcccggcaagaacccccgggccgugcagaccaagcccgggcuguucaagaccaacaccggcacgaucggggccgugagccuggacuucucccccggcaccagcggcucccccaucgucgacaagaaggggaagguggugggccucuacgggaacggcgucgugacccgcagcggcaccuacguguccgcgaucgcccagacggagaaguccaucgaggacaaccccgagaucgaggacgacaucuuccggaagaagcgccugaccaucauggaccugcaccccggggccggcaagaccaagcgguaccugcccgccaucguccgcgaggcgaucaagcgggggcuccgcacccugauccuggccccgacgcgggugguggccgccgagauggaggaggcccuccgcggccugcccauccgcuaccagacccccgcgauccgggccgagcacaccgggcgcgagaucgucgaccugaugugccacgccaccuucacgaugcggcuccugagccccauccgcgugccgaacuacaaccugaucaucauggacgaggcccacuucaccgaccccgccuccaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucaccgacuucaagggcaagaccgugugguucgugccguccaucaaggccgggaacgacaucgccgccugccuccgcaagaacggcaagaaggucauccagcugagccggaagaccuucgacuccgaguacgugaagacgcgcaccaacgacugggacuucguggucaccaccgacaucagcgagaugggcgcgaacuucaaggccgagcgggugaucgacccccgccggugcaugaagcccgugauccugacggacggggaggagcgcgucauccucgccggccccaugccggugacccacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucguggaccugaugcgccggggcgaccuccccgucuggcuggccuaccgcguggcggccgaggggaucaacuacgccgaccggcgcuggugcuucgacggcgugaagaacaaccagauccuggaggagaacgucgagguggagaucuggacgaaggagggggagcggaagaagcucaagccgcgcuggcuggacgcccggaucuacagcgacccccuggcccucaaggaguucaaggaguucgcggccggccgcaagucccugacccugaaccucaucaccgagaugggccggcugcccaccuucaugacgcagaaggcccgcaacgcccuggacaaccucgcggugcugcacaccgccgaggccgggggccgggccuacaaccacgcccugagcgagcuccccgagacccuggagacccugcuccugcugacgcuccuggcgaccgucaccgggggcaucuuccuguuccucauguccggcaaggggaucggcaagaugacccuggggaugugcugcaucaucaccgccagcgugcugcucugguacgcccagauccagccgcacuggaucgccgccuccaucauccuggaguucuuccugaucgugcuccugauccccgagcccgagaagcagcgcacgccccaggacaaccagcugaccuacgucgugaucgcgauccucaccguggucgccgccaccauggccaacgagaugggcuuccuggagaagacgaagaaggacuucgggcugggcggcaucgccacccagcagccggagagcaacauccucgacaucgaccugcggcccgcgagcgccuggacccuguacgccguggccaccacguucaucacccccaugcuccgccacuccaucgagaacagcuccgugaacgucagccugaccgccaucgcgaaccaggccaccgugcugauggggcucggcaagggguggccccuguccaagauggacaucggcgugccgcugcucgccaucgggugcuacagccaggucaaccccaucacgcugaccgccgcgcugcuccugcugguggcccacuacgccaucaucggccccggccuccaggccaaggccacccgggaggcgcagaagcgcgccgccgccgggaucaugaagaaccccaccguggacggcaucacggucaucgaccuggacccgauccccuacgaccccaaguucgagaagcagcuggggcaggucaugcuccuggugcugugcgucacccaggugcucaugaugcggaccaccugggcccugugcgaggcgcugacgcucgccaccggccccaucuccacccugugggaggggaacccgggccgcuucuggaacaccacgaucgccgugagcauggccaacaucuuccgcggcuccuaccuggccggggcgggccuccuguucagcaucaugaagaacaccgccaacacccggcgcgggaccggcaacacgggcgagacccugggggagaaguggaagaaccggcucaacgcccugggcaaguccgaguuccagaucuacaagaaguccgggauccaggaggucgaccgcacccuggccaaggagggcaucaagcgcggggagaccgaccaccacgcggugucccgcggcagcgccaagcuccggugguucguggagcgcaaccuggucacgcccgagggcaaggugauggaccuggggugcggccgcggcgggugguccuacuacugcggcgggcucaagaacgugaaggaggucaaggggcugaccaagggcgggcccgggcacgaggagcccaucccgaugagcaccuacggcuggaaccuggugcgccuccaguccgggguggacgucuucuucacgccgcccgagaagugcgacacgcugcugugcgacaucggcgagagcucccccaacccgaccguggaggccggccggacccuccgcgugcugaaccuggucgagaacuggcucaacaacaacacccaguucugcaucaaggugcugaaccccuacaugcccagcgugaucgagaagauggaggcccugcagcggaaguacgggggcgcccugguccgcaacccgcucagccggaacuccacccacgagauguacugggugagcaacgcguccgggaacaucgugagcuccgucaacaugaucagccgcaugcugaucaaccgguucacgaugcgccacaagaaggccaccuacgagcccgacguggaccugggcuccgggacccggaacaucggcaucgagagcgagacccccaaccucgacaucaucggcaagcgcaucgagaagaucaagcaggagcacgagacguccuggcacuacgaccaggaccaccccuacaagaccugggccuaccacgggagcuacgagaccaagcagaccggcuccgccagcuccauggugaacggggucgugcgccugcugacgaagccgugggacgucauccccauggugacccagauggccaugaccgacaccacgcccuucggccagcagcggguguucaaggagaaggucgacacccgcacccaggagcccaaggagggcaccaagaagcucaugaagaucacggcggaguggcuguggaaggagcuggggaagaagaagaccccgcggaugugcacccgcgaggaguucacccggaaggugcgcagcaacgccgcccucggcgccaucuucacggacgagaacaaguggaaguccgcccgggaggcgguggaggacagcggguucugggagcuggucgacaaggagcgcaaccugcaccucgagggcaagugcgagaccugcguguacaacaugauggggaagcgggagaagaagcugggcgaguucggcaaggccaaggggucccgcgccaucugguacauguggcugggcgcccgguuccucgaguucgaggcgcugggguuccugaacgaggaccacugguucagccgcgagaacucccucagcggcguggagggggagggccugcacaagcugggcuacauccuccgggacgucagcaagaaggagggcggcgccauguacgccgacgacaccgccgggugggacacccgcaucacgcuggaggaccugaagaacgaggagauggugaccaaccacauggagggcgagcacaagaagcucgccgaggcgaucuucaagcugaccuaccagaacaaggugguccgggugcagcgccccacgccccgggggacggugauggacaucaucucccgccgggaccagcgcggcagcggccaggucgugaccuacgggcugaacaccuucaccaacauggaggcccagcucauccggcagauggagggcgaggggguguucaaguccauccagcagcugacggccaccgaggagaucgccgucaagaacuggcuggcccgcgugggccgcgagcggcucagccgcauggcgaucuccggcgacgacugcguggucaagccccuggacgaccgguucgccagcgcccugaccgcccucaacgacauggggaaggugcgcaaggacauccagcagugggagccgucccggggcuggaacgacuggacccaggugcccuucugcagccaccacuuccacgagcugaucaugaaggacgggcgcguccugguggugcccugccggaaccaggacgagcucaucggccgcgcccggaucucccagggggcgggcuggagccugcgcgagacggccugccugggcaaguccuacgcccagauguggagccucauguacuuccaccggcgcgaccugcggcuggccgccaacgcgaucugcuccgccguccccagccacugggugccgaccucccgcaccaccuggagcauccacgccacccacgaguggaugacgaccgaggacaugcucaccguguggaaccgggucuggauccaggagaaccccuggaucgaggacaagacccccguggaguccugggaggagauccccuaccuggggaagcgcgaggaccaguggugcggcagccugaucgggcucacgagccgggccaccugggcgaagaacauccagaccgccaucaaccaggugcgcucccugaucggcaacgaggaguacaccgacuacaugccgagcaugaagcgguuccgccgcgaggaggaggaggccgggguccugugguga

SEQ ID NO: 9795 - RNA, 9876 nt, Artificial Sequence
  derived and/or modified CDS sequence (opt1) from DENV-2__DQ645542__SS-prME
accgccggcgugaucaucaugaugauccccaccgucguggccuuccaccugaccacccggaacggggagccccacaugaucgugagccggcaggagaagggcaagagccuccuguucaagaccgagaacggggucaacaugugcacccugauggcgauggaccucggcgagcugugcgaggacaccaucaccuacaacugcccccugcuccggcagaacgagcccgaggacaucgacugcuggugcaacagcaccagcaccugggugaccuacgggaccugcaccgccaccggcgagcaccggcgcgagaagcggagcguggcccuggucccccacgugggcauggggcuggagacgcggaccgagaccuggauguccagcgagggcgccuggaagcacgcccagcggaucgagaccugggugcuccgccaccccggguucacgaucauggcggccauccuggccuacaccaucggcaccaccuacuuccagcggguccugaucuucauccuccugacggccguggcgcccuccaugaccaugcgcugcaucgggaucagcaaccgggacuucguggagggcgucuccggcgggagcuggguggacaucgugcuggagcacggcuccugcgucaccaccauggccaagaacaagcccacgcucgacuucgagcugaccaagaccgaggccaagcaccccgccacccugcgcaaguacugcaucgaggccaagcucacgaacaccaccaccgcgagccggugcccgacgcagggggagcccucccugaacgaggagcaggacaagcgcuucgugugcaagcacagcaugguggaccggggcuggggcaacgggugcggccuguucgggaagggcgggaucgugaccugcgccauguucacgugcaagaagaacauggagggcaagguggugcagcccgagaaccucgaguacaccaucgucaucacgccccacuccggcgaggagaacgccguggggaacgacaccggcaagcacgggaaggagaucaaggugaccccgcagagcuccaucaccgaggccgagcugaccggcuacgggacggucaccauggagugcagcccccgcaccggccuggacuucaacgagauggugcuccugcagauggaggacaaggccuggcugguccaccggcagugguuccucgaccugccccugcccuggcucccgggcgcggacacccagggguccaacuggauccagaaggagacgcuggugaccuucaagaacccccacgccaagaagcaggacguggucgugcugggcagccaggagggggccaugcacaccgcccucaccggcgccacggagauccagaugagcuccgggaaccugcuguucaccggccaccucaagugccgccugcggauggacaagcugcagcucaagggcaugagcuacuccaugugcaccgggaaguucaagguggucaaggagaucgcggagacccagcacggcacgaucgugauccgcgugcaguacgagggggacggcagccccugcaagauccccuucgagaucauggaccuggagaagcggcacguccugggccgccucaucaccgugaacccgaucgugaccgagaaggacucccccgucaacaucgaggccgagccgcccuucggggacagcuacaucaucaucggcguggagccggggcagcugaagcuguccugguucaagaagggcagcuccaucgggcagauguucgagaccacgaugcgcggcgccaagcggauggccauccucggcgacaccgccugggacuucgggagccugggcgggguguucaccuccaucggcaaggcgcugcaccaggucuucggggccaucuacggcgccgccuucagcggcguguccuggaccaugaagauccucaucgggguggucaucacguggaucggcaugaacagccgcuccaccagccuguccgugagccuggugcuggucgggguggugacccucuaccugggcgucauggugcaggcggacuccgggugcguggucagcuggaagaacaaggagcugaagugcggcagcggcaucuucaucaccgacaacgugcacacguggaccgagcaguacaaguuccagcccgagucccccagcaagcucgccuccgccauccagaaggcccacgaggaggggaucugcggcauccggagcgugacccgccuggagaaccugauguggaagcagaucacccccgagcucaaccacauccuguccgagaacgaggucaagcugacgaucaugaccggggacaucaagggcaucaugcaggccgggaagcggagccuccgcccgcagcccaccgagcugaaguacuccuggaaggcguggggcaaggccaagaugcugagcaccgagcuccacaaccacacguuccugaucgacggccccgagaccgccgagugcccgaacaccaaccgggccuggaacucccuggagguggaggacuacggguucggcguguucaccacgaacaucuggcucaagcugaaggagcgccaggacgucuucugcgacagcaagcugauguccgccgcgaucaaggacaaccgggccgugcacgccgacaugggguacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgcgggccccgugagccagcacaacuaccgcccgggguaccacacccagaccgccggccccuggcaccucgggaagcuggagauggacuucgacuucugcgagggcacgaccguggucgugaccgaggacugcgggaaccggggccccagccugcgcaccacgaccgccuccggcaagcucaucaccgaguggugcugccggagcugcacccugcccccgcugcgcuaccgcggggaggacggcugcugguacgggauggagauccgcccccucaaggagaaggaggagaaccuggugaacucccuggucacggccggccacgggcagaucgacaacuucagccucggcgugcugggcauggcgcuguuccucgaggagaugcugcggacccgcguggggaccaagcacgccauccugcucgucgccguguccuucgugacccugaucacgggcaacaugagcuuccgggaccuggggcgcgucauggugauggugggcgccaccaugaccgacgacaucgggaugggcgucaccuaccucgcccugcuggcggccuucaaggugcgccccacguucgccgccggccuccugcugcggaagcucaccuccaaggagcugaugaugaccaccaucgggaucguccugcucagccaguccacgauccccgagaccauccuggagcugaccgacgcccucgcgcugggcaugauggugcugaagaucgugcgcaacauggagaaguaccagcucgccgucaccaucauggccauccugugcgugccgaacgccgugauccugcagaacgccuggaaggucagcugcacgauccucgcggugguguccgucagcccccugcugcucaccuccagccagcagaaggccgacuggaucccccuggcccugaccaucaaggggcucaaccccaccgccaucuuccugacgacccugucccggaccagcaagaagcgcuccuggccgcucaacgaggcgaucauggccgugggcauggugagcauccuggccuccagccugcucaagaacgacauccccaugaccggcccccuggucgccgggggccugcucacggugugcuacgugcugaccgggcggagcgccgaccuggagcucgagcgcgcggccgacguccggugggaggagcaggccgagaucuccggcagcucccccauccugagcaucaccaucuccgaggacgggagcauguccaucaagaacgaggaggaggagcagacccugacgauccucauccgcaccggccugcuggugaucagcggccucuucccgguguccauccccaucaccgccgccgcgugguaccugugggaggucaagaagcagcgggccggggugcugugggacgugcccagcccgccgcccgucggcaaggccgagcucgaggacggggccuaccgcaucaagcagaagggcauccugggguacucccagaucggcgccggcguguacaaggaggggaccuuccacaccauguggcacgugacgcggggcgcgguccugaugcacaaggggaagcgcaucgagcccagcugggccgacgugaagaaggaccucaucuccuacggcgggggcuggaagcuggagggcgaguggaaggagggggaggaggugcagguccuggcccucgagcccggcaagaacccccgggccgugcagaccaagcccgggcuguucaagaccaacaccggcacgaucggggccgugagccuggacuucucccccggcaccagcggcucccccaucgucgacaagaaggggaagguggugggccucuacgggaacggcgucgugacccgcagcggcaccuacguguccgcgaucgcccagacggagaaguccaucgaggacaaccccgagaucgaggacgacaucuuccggaagaagcgccugaccaucauggaccugcaccccggggccggcaagaccaagcgguaccugcccgccaucguccgcgaggcgaucaagcgggggcuccgcacccugauccuggccccgacgcgggugguggccgccgagauggaggaggcccuccgcggccugcccauccgcuaccagacccccgcgauccgggccgagcacaccgggcgcgagaucgucgaccugaugugccacgccaccuucacgaugcggcuccugagccccauccgcgugccgaacuacaaccugaucaucauggacgaggcccacuucaccgaccccgccuccaucgcggcccggggcuacaucagcacccgcguggagaugggcgaggccgccgggaucuucaugaccgccacgccgcccggcucccgggacccguucccccagagcaacgcgcccaucauggacgaggagcgcgagauccccgagcgguccuggaacagcgggcacgagugggucaccgacuucaagggcaagaccgugugguucgugccguccaucaaggccgggaacgacaucgccgccugccuccgcaagaacggcaagaaggucauccagcugagccggaagaccuucgacuccgaguacgugaagacgcgcaccaacgacugggacuucguggucaccaccgacaucagcgagaugggcgcgaacuucaaggccgagcgggugaucgacccccgccggugcaugaagcccgugauccugacggacggggaggagcgcgucauccucgccggccccaugccggugacccacuccagcgccgcccagcggcgcgggcgggucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccggaagaccuucguggaccugaugcgccggggcgaccuccccgucuggcuggccuaccgcguggcggccgaggggaucaacuacgccgaccggcgcuggugcuucgacggcgugaagaacaaccagauccuggaggagaacgucgagguggagaucuggacgaaggagggggagcggaagaagcucaagccgcgcuggcuggacgcccggaucuacagcgacccccuggcccucaaggaguucaaggaguucgcggccggccgcaagucccugacccugaaccucaucaccgagaugggccggcugcccaccuucaugacgcagaaggcccgcaacgcccuggacaaccucgcggugcugcacaccgccgaggccgggggccgggccuacaaccacgcccugagcgagcuccccgagacccuggagacccugcuccugcugacgcuccuggcgaccgucaccgggggcaucuuccuguuccucauguccggcaaggggaucggcaagaugacccuggggaugugcugcaucaucaccgccagcgugcugcucugguacgcccagauccagccgcacuggaucgccgccuccaucauccuggaguucuuccugaucgugcuccugauccccgagcccgagaagcagcgcacgccccaggacaaccagcugaccuacgucgugaucgcgauccucaccguggucgccgccaccauggccaacgagaugggcuuccuggagaagacgaagaaggacuucgggcugggcggcaucgccacccagcagccggagagcaacauccucgacaucgaccugcggcccgcgagcgccuggacccuguacgccguggccaccacguucaucacccccaugcuccgccacuccaucgagaacagcuccgugaacgucagccugaccgccaucgcgaaccaggccaccgugcugauggggcucggcaagggguggccccuguccaagauggacaucggcgugccgcugcucgccaucgggugcuacagccaggucaaccccaucacgcugaccgccgcgcugcuccugcugguggcccacuacgccaucaucggccccggccuccaggccaaggccacccgggaggcgcagaagcgcgccgccgccgggaucaugaagaaccccaccguggacggcaucacggucaucgaccuggacccgauccccuacgaccccaaguucgagaagcagcuggggcaggucaugcuccuggugcugugcgucacccaggugcucaugaugcggaccaccugggcccugugcgaggcgcugacgcucgccaccggccccaucuccacccugugggaggggaacccgggccgcuucuggaacaccacgaucgccgugagcauggccaacaucuuccgcggcuccuaccuggccggggcgggccuccuguucagcaucaugaagaacaccgccaacacccggcgcgggaccggcaacacgggcgagacccugggggagaaguggaagaaccggcucaacgcccugggcaaguccgaguuccagaucuacaagaaguccgggauccaggaggucgaccgcacccuggccaaggagggcaucaagcgcggggagaccgaccaccacgcggugucccgcggcagcgccaagcuccggugguucguggagcgcaaccuggucacgcccgagggcaaggugauggaccuggggugcggccgcggcgggugguccuacuacugcggcgggcucaagaacgugaaggaggucaaggggcugaccaagggcgggcccgggcacgaggagcccaucccgaugagcaccuacggcuggaaccuggugcgccuccaguccgggguggacgucuucuucacgccgcccgagaagugcgacacgcugcugugcgacaucggcgagagcucccccaacccgaccguggaggccggccggacccuccgcgugcugaaccuggucgagaacuggcucaacaacaacacccaguucugcaucaaggugcugaaccccuacaugcccagcgugaucgagaagauggaggcccugcagcggaaguacgggggcgcccugguccgcaacccgcucagccggaacuccacccacgagauguacugggugagcaacgcguccgggaacaucgugagcuccgucaacaugaucagccgcaugcugaucaaccgguucacgaugcgccacaagaaggccaccuacgagcccgacguggaccugggcuccgggacccggaacaucggcaucgagagcgagauccccaaccucgacaucaucggcaagcgcaucgagaagaucaagcaggagcacgagaccuccuggcacuacgaccaggaccaccccuacaagacgugggccuaccacgggagcuacgagaccaagcagaccggcuccgccagcuccauggugaacggggucgugcgccugcugaccaagccgugggacgucauccccauggugacgcagauggccaugaccgacaccacccccuucggccagcagcggguguucaaggagaaggucgacacgcgcacccaggagcccaaggagggcaccaagaagcucaugaagaucaccgcggaguggcuguggaaggagcuggggaagaagaagacgccgcggaugugcacccgcgaggaguucacccggaaggugcgcagcaacgccgcccucggcgccaucuucaccgacgagaacaaguggaaguccgcccgggaggcgguggaggacagcggguucugggagcuggucgacaaggagcgcaaccugcaccucgagggcaagugcgagacgugcguguacaacaugauggggaagcgggagaagaagcugggcgaguucggcaaggccaaggggucccgcgccaucugguacauguggcugggcgcccgguuccucgaguucgaggcgcugggguuccugaacgaggaccacugguucagccgcgagaacucccucagcggcguggagggggagggccugcacaagcugggcuacauccuccgggacgucagcaagaaggagggcggcgccauguacgccgacgacaccgccgggugggacacccgcaucacccuggaggaccugaagaacgaggagauggugacgaaccacauggagggcgagcacaagaagcucgccgaggcgaucuucaagcugaccuaccagaacaaggugguccgggugcagcgccccacgccccgggggaccgugauggacaucaucucccgccgggaccagcgcggcagcggccaggucgugacguacgggcugaacaccuucaccaacauggaggcccagcucauccggcagauggagggcgaggggguguucaaguccauccagcagcugaccgccacggaggagaucgccgucaagaacuggcuggcccgcgugggccgcgagcggcucagccgcauggcgaucuccggcgacgacugcguggucaagccccuggacgaccgguucgccagcgcccugaccgcccucaacgacauggggaaggugcgcaaggacauccagcagugggagccgucccggggcuggaacgacuggacccaggugcccuucugcagccaccacuuccacgagcugaucaugaaggacgggcgcguccugguggugcccugccggaaccaggacgagcucaucggccgcgcccggaucucccagggggcgggcuggagccugcgcgagaccgccugccugggcaaguccuacgcccagauguggagccucauguacuuccaccggcgcgaccugcggcuggccgccaacgcgaucugcuccgccguccccagccacugggugccgacgucccgcaccaccuggagcauccacgccacccacgaguggaugaccacggaggacaugcucaccguguggaaccgggucuggauccaggagaaccccuggaucgaggacaagacccccguggaguccugggaggagauccccuaccuggggaagcgcgaggaccaguggugcggcagccugaucgggcucaccagccgggccacgugggcgaagaacauccagaccgccaucaaccaggugcgcucccugaucggcaacgaggaguacaccgacuacaugccgagcaugaagcgguuccgccgcgaggaggaggaggccgggguccugugguga

SEQ ID NO: 9796 - RNA, 9876 nt, Artificial Sequence
  derived and/or modified CDS sequence (opt1) from DENV-2__AY702036__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcgccagaacgagcccgaggacaucgacugcuggugcaacuccaccuccaccugggucaccuacgggaccugcaccaccacgggcgagcaccggcgcgagaagcgguccguggcccuggugccccacgucgggaugggccucgagacccggaccgagaccuggaugagcuccgagggggccuggaagcacgugcagcggaucgagaccuggauccugcgccacccgggcuucaccaucauggccgcgauccuggccuacaccaucgggaccacccacuuccagcgggcccucaucuucauccugcugaccgccguggcgcccagcaugaccaugcgcugcaucggcaucuccaaccgggacuucgucgagggcgugagcgggggcuccuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucuccaccaacaucuggcucaagcugcgcgagaagcaggacguguucugcgacagcaagcugauguccgccgccaucaaggacaaccgggcgguccacgccgacaugggcuacuggaucgagagcgcccucaacgacaccuggaagauggagaaggccuccuucaucgaggucaagagcugccacuggcccaagucccacacccuguggagcaacggcgugcuggaguccgagaugaucauccccaagaacuucgccgggcccgugagccagcacaacuaccgcccgggcuaccacacccagacggcggggcccuggcaccucggcaagcuggagauggacuucgacuucugcgaggggaccaccgugguggucaccgaggacugcggcaaccggggccccagccugcgcacgaccaccgccuccgggaagcucaucaccgaguggugcugccggagcugcacgcugcccccgcugcgcuaccggggcgaggacgggugcugguacggcauggagauccgcccccucaaggagaaggaggagaaccuggugaacucccuggugaccgccgggcacggccagaucgacaacuucagccucggcguccuggggauggcccuguuccucgaggagaugcugcggacccgcgugggcaccaagcacgcgauccugcucguggccgucuccuucgugacgcugaucaccgggaacaugagcuuccgggaccugggccgcgugauggucauggugggggccaccaugaccgacgacaucggcaugggcgugacguaccucgcccugcuggccgcguucaagguccgccccaccuucgccgccgggcuccugcugcggaagcucaccuccaaggagcugaugauggccaccaucggcaucgcccugcucagccaguccacgaugcccgagaccauccuggagcugaccgacgcgcucgcccuggggaugauggugcugaagaucgugcgcaacauggagaaguaccagcucgccgucaccaucauggccaucagcugcgugccgaacgccgugauccugcagaacgcguggaaggucuccugcacgauccuggccgccgugagcgucagcccccuccugcugaccagcucccagcagaaggccgacuggaucccccucgcgcugaccaucaagggccugaaccccaccgccaucuuccucacgacccugagccggaccuccaagaagcgcagcuggccgcugaacgaggccaucauggccgugggcaugguguccauccucgccagcagccugcugaagaacgacauccccaugaccgggccccucgucgcgggcgggcugcugacggugugcuacgugcucaccggccgguccgccgaccuggagcuggagcgcgccgccgacgucaagugggaggaccaggccgagaucagcggguccagccccauccucuccaucaccaucagcgaggacggcuccaugagcaucaagaacgaggaggaggagcagacccugacgauccugauccggaccggccuccuggugaucuccgggguguucccggucagcauccccaucaccgcggccgccugguaccugugggaggugaagaagcagcgcgccggcgugcucugggacguccccagcccgccgcccguggggaaggccgagcuggaggacggcgcguaccggaucaagcagcgcgggauccugggcuacagccagaucggcgccgggguguacaaggagggcaccuuccacaccauguggcacgucacgcgcggggccgugcucaugcaccgcggcaagcggaucgagcccuccugggccgacgugaagaaggaccugaucagcuacgggggcggcuggaagcuggagggggaguggaaggagggcgaggagguccaggugcucgcccuggagcccgggaagaacccccgcgcggugcagaccaagcccggcaucuucaagaccaacaccgggacgaucggcgccgucucccuggacuucagccccggcaccuccgggagccccaucguggaccggaagggcaagguggucgggcucuacggcaacggcguggugacccgcuccggggccuacgucagcgccaucgcgcagaccgagaaguccaucgaggacaaccccgagaucgaggacgacaucuuccggaagaagcgccugacgaucauggaccugcaccccggcgccgggaagaccaagcgguaccuccccgccaucgugcgcgaggccaucaaccggggccugcgcacccugauccuggccccgacccgcguggucgcggccgagauggaggaggcccuccgggggcugcccauccgcuaccagacgcccgccauccgggccgagcacaccggccgcgagaucguggaccugaugugccacgcgaccuucaccaugcggcuccugucccccgugcgcgucccgaacuacaaccugaucaucauggacgaggcccacuucacggaccccgccagcaucgccgcccggggcuacaucuccacccgcguggagaugggggaggcggccggcaucuucaugaccgccacgccgcccgggagccgggacccguucccccaguccaacgcccccaucauggacgaggagcgcgagauccccgagcggagcuggaacuccggccacgagugggugacggacuucaaggggaagaccgucugguucgugccgagcaucaaggcgggcaacgacaucgccgccugccuccgcaagaacggcaagaaggugauccagcugucccggaagaccuucgacagcgaguacgucaagacccgcgccaacgacugggacuucguggugacgaccgacaucuccgagaugggggccaacuucaaggcggagcgggucaucgacccccgccggugcaugaagcccgugauccugaccgacggcgaggagcgcgugauccucgccgggcccaugccggucacccacagcuccgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacgcccgagggcaucaucccgagcauguucgagcccgagcgcgagaagguggacgccaucgacggggaguaccggcugcgcggcgaggcccggaagaccuucguggaccugaugcgccgcggggaccuccccgucuggcuggccuacaagguggccgcggagggcaucaacuacgccgaccgcaaguggugcuucgacgggaucaagaacaaccagauccuggaggagaacguggaggucgagaucuggaccaaggagggcgagcggaagaagcucaagccgcgcuggcuggacgcccggaucuacuccgacccccuggcccucaaggaguucaaggaguucgcggccggccgcaagagccugacccugaaccucaucacggagauggggcggcugcccaccuucaugacccagaaggcccgcaacgcccuggacaaccucgccgugcugcacaccgcggaggccggcgggcgggccuacaaccacgcccuguccgagcuccccgagacgcuggagacccugcuccugcugacccuccuggccaccgucacgggcggcaucuuccuguuccucaugagcgggaagggcaucgggaagaugacccugggcaugugcugcaucaucaccgcguccagccugcucugguacgcccagauccagccgcacuggaucgccgccagcaucauccuggaguucuuccugaucgugcuccugauccccgagcccgagaagcagcgcacgccccaggacaaccagcugaccuacguggucaucgccauccucacggugguggcggccaccauggccaacgagaugggguuccuggagaagaccaagaaggaccugggccucggcuccaucaccacgcaggagagcgaguccaacauccuggacaucgaccugcggccggccagcgccuggacccucuacgcggucgccaccaccuucgugacgcccaugcugcgccacuccaucgagaacagcuccgugaacgucagccugaccgccaucgccaaccaggcgaccgugcucauggggcugggcaagggguggccccuguccaagauggacaucggcgugccccuccuggccaucgggugcuacagccaggucaacccgaucacccugacggccgcccuccugcugcucguggcccacuacgcgaucaucggccccggccugcaggccaaggccacccgggaggcccagaagcgcgccgcggccgggaucaugaagaaccccaccguggacggcaucaccgucaucgaccuggagcccaucccguacgaccccaaguucgagaagcagcucgggcaggucaugcugcugauccucugcgugacgcagguccugaugaugcggaccaccugggcccugugcgaggcccucacccuggccacgggccccaucuccacccugugggaggggaaccccggccgcuucuggaacaccaccaucgcggugagcauggccaacaucuuccgcggcuccuaccucgccggggccggccugcuguucagcaucaugaagaacacgaccaacacccggcgcgggaccggcaacaucggcgagacgcucggggagaaguggaagucccggcugaacgcgcugggcaagagcgaguuccagaucuacaagaaguccgggauccaggagguggaccgcacccucgccaaggagggcaucaagcgcggggagaccgaccaccacgccgucagccgcggcuccgccaagcugcggugguucguggagcgcaacauggugaccccggagggcaaggucguggaccuggggugcggccgcgggggcuggagcuacuacugcgggggccucaagaacgugcgcgaggucaagggccugacgaagggcggccccgggcacgaggagcccauccccaugagcaccuacggcuggaaccuggugcggcuccaguccgggguggacgucuucuucaccccgcccgagaagugcgacacccugcugugcgacaucggcgagagcucccccaaccccacgaucgaggccggccgcacccuccgggugcugaaccugguggagaacuggcucaacaacaacacccaguucugcaucaagguccugaacccguacaugcccagcgugaucgagaagauggagacccugcagcgcaaguacgggggcgcgcucgugcggaacccccugucccgcaacagcacccacgagauguacugggucuccaacgccacggggaacaucgugagcuccgugaacaugaucagccggaugcugaucaaccgcuucaccaugaagcacaagaaggccaccuacgagccggacgucgaccugggcuccgggacccggaacaucggcaucgagagcgagauccccaaccucgacaucaucggcaagcgcaucgagaagaucaagcaggagcacgagacguccuggcacuacgaccaggaccaccccuacaagaccugggccuaccacgggagcuacgagaccaagcagaccggcuccgccagcuccauggugaacggggugguccgccugcugacgaagcccugggacguggugccgauggucacccagauggcgaugaccgacaccacgcccuucggccagcagcggguguucaaggagaagguggacacccgcacccaggagcccaaggagggcaccaagaagcucaugaagaucacggccgaguggcuguggaaggagcuggggaagaagaagacgccccggaugugcacccgcgaggaguucacccggaagguccgcagcaacgccgcccucggcgccaucuucacggacgagaacaaguggaaguccgcgcgggaggccguggaggacgggcgcuucugggagcugguggaccgggagcgcaaccugcaccucgagggcaagugcgagaccugcgucuacaacaugauggggaagcgggagaagaagcugggcgaguucggcaaggccaaggggagccgcgccaucugguacauguggcugggcgcgcgguuccucgaguucgaggcccugggguuccugaacgaggaccacugguucagccgcggcaacucccucagcgggguggagggcgagggccugcaccggcugggguacauccuccgcgaggucggcaagaaggagggcggcgccauguacgccgacgacaccgccgggugggacacccggaucacgcuggaggaccugaagaacgaggagauggugaccaaccacaugaagggcgagcacaagaagcucgcggaggccaucuucaagcugaccuaccagaacaaggugguccgcgugcagcggccgacgccccggggcacggugauggacaucaucucccggcgcgaccagcgcgggagcggccaggucgggaccuacggccugaacaccuucaccaacauggaggcccagcucauccggcagauggagggcgaggggaucuucaaguccauccagcaccugacggccaccgaggagaucgccgugcagaacuggcuggcgcgcgugggccgggagcgccucagccggauggccaucuccggggacgacugcgucgugaagcccaucgacgaccgcuucgccagcgcccugaccgcccugaacgacaugggcaaggugcggaaggacauccagcagugggagcccucccgcggguggaacgacuggacccaggucccguucugcagccaccacuuccacgagcucgugaugaaggacggccgggugcuggucgugcccugccgcaaccaggacgagcugaucggccgggcgcgcaucucccagggggccggcuggagccucaaggagacggccugccuggggaaguccuacgcccagauguggacccugauguacuuccaccggcgcgaccuccggcuggccgcgaacgccaucugcagcgccgugcccucccacuggguccccaccagccgcaccaccugguccauccacgccaagcacgaguggaugacgaccgaggacaugcuggcgguguggaaccggguguggauccaggagaacccguggauggaggacaagacccccgucgagagcugggaggaggugcccuaccucggcaagcgcgaggaccaguggugcgggagccugaucggccugaccucccgggccacgugggccaagaacauccagaccgccaucaaccaggugcgcagccucaucggcaacgaggaguacaccgacuacaugcccuccaugaagcgcuuccggcgcgaggaggaggaggccgggguccugugguga

SEQ ID NO: 9797 - RNA, 9876 nt, Artificial Sequence
  derived and/or modified CDS sequence (opt1) from DENV-2__AY702034__SS-prME
accgccggcgugaucgucaugcugauccccaccgccauggcguuccaccucaccacccggaacggggagccccacaugaucgugggccggcaggagaaggggaagucccugcuguucaagaccgaggacggcgugaacaugugcacccucauggccaucgaccugggggagcugugcgaggacaccaucaccuacaagugcccccuccugcggcagaacgagcccgaggacaucgacugcuggugcaacagcaccagcaccugggucaccuacgggaccugcaccaccacgggcgagcaccggcgcgagaagcgguccguggcccuggugccccacgucgggaugggccucgagacccgcaccgagaccuggaugagcagcgagggggccuggaagcacgugcagcggaucgagacguggauccugcggcacccgggcuucaccaucauggccgcgauccuggccuacaccaucgggaccacgcacuuccagcgggcccucaucuucauccugcugaccgccguggcgcccagcaugaccaugcgcugcaucggcaucagcaaccgggacuucgucgagggcgugagcgggggcagcuggguggacaucguccucgagcacgggagcugcgugaccacgauggccaagaacaagcccacccuggacuucgagcugaucaagaccgaggccaagcagcccgccacccuccgcaaguacugcaucgaggccaagcugacgaacaccaccaccgagucccggugcccgacgcagggcgagcccagccugaacgaggagcaggacaagcgcuucaucugcaagcacuccaugguggaccggggcugggggaacggcugcgggcuguucggcaagggcgggaucgugaccugcgcgauguucacgugcaagaagaacauggagggcaagguggugcagcccgagaaccuggaguacaccaucgucaucacgccccacagcggggaggagcacgccgugggcaacgacaccgggaagcacggcaaggagaucaagaucaccccgcaguccagcaucaccgaggccgagcugaccggguacggcacggugaccauggagugcagcccccggaccggccucgacuucaacgagaugguccugcugcagauggaggacaaggccuggcucgugcaccggcagugguuccuggaccugccccuccccuggcugccgggggccgacacccagggcagcaacuggauccagaaggagacgcuggugaccuucaagaacccccacgcgaagaagcaggacgucgugguccucgggucccaggagggcgccaugcacaccgcccugaccggggccacggagauccagaugagcagcggcaaccuccuguucaccggccaccugaagugccgccugcggauggacaagcuccagcugaaggggauguccuacagcaugugcaccggcaaguucaagaucgugaaggagaucgccgagacccagcacgggacgaucgugauccgcguccaguacgagggcgacggcucccccugcaagauccccuucgagaucaccgaccuggagaagcggcacgugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccaucggccagauguucgagacgaccaugcgcggcgccaagcggauggccauccugggggacaccgccugggacuucggcagccucggcggggucuucaccuccaucgggaaggcccuccaccagguguucggggcgaucuacggcgccgccuucagcgggguguccuggacgaugaagauccugaucggcgucaucaucaccuggaucgggaugaacagccgcuccaccagccuguccgugagccuggugcucgucggcguggugacccuguaccugggggccaugguccaggcggacuccggcugcguggugagcuggaagaacaaggagcucaagugcggcuccgggaucuucaucacggacaacguccacaccuggaccgagcaguacaaguuccagcccgagagccccagcaagcuggccuccgccauccagaaggcccacgaggagggcaucugcgggauccggagcgugacccgccuggagaaccucauguggaagcagaucacgcccgagcugaaccacauccuguccgagaacgaggugaagcucaccaucaugaccggcgacaucaaggggaucaugcaggccggcaagcggagccugcgcccgcagcccaccgagcugaaguacuccuggaagacguggggcaaggcgaagaugcucagcaccgagucccacaaccagaccuuccugaucgacgggcccgagaccgccgagugcccgaacacgaaccgggccuggaacagccuggaggucgaggacuacggcuucgggguguucaccaccaacaucuggcucaagcugcgcgagaagcaggacguguucugcgacuccaagcugaugagcgccgccaucaaggacaaccgggcgguccacgccgacaugggcuacuggaucgaguccgcccucaacgacaccuggaagauggagaaggccagcuucaucgaggugaaguccugccacuggcccaagagccacacccugugguccaacggcgugcuggagagcgagaugaucauccccaagaacuucgccgggcccgucucccagcacaacuaccgcccgggcuaccacacgcagaccgcggggcccuggcaccucggcaagcuggagauggacuucgacuucugcgaggggaccaccgugguggucacggaggacugcggcaaccggggccccagccugcgcaccaccaccgccagcgggaagcucaucacggaguggugcugccgguccugcacccugcccccgcugcgcuaccggggcgaggacgggugcugguacggcauggagauccgcccccucaaggagaaggaggagaaccuggugaacagccuggugaccgccgggcacggccagaucgacaacuucucccucggcguccuggggauggcccuguuccucgaggagaugcugcggacccgcgugggcacgaagcacgcgauccugcucguggccgucagcuucgugacccugaucaccgggaacauguccuuccgggaccugggccgcgugauggucauggugggggccaccaugacggacgacaucggcaugggcgugaccuaccucgcccugcuggccgcguucaagguccgccccaccuucgccgccgggcuccugcugcggaagcucaccagcaaggagcugaugauggccacgaucggcaucgcccugcucucccagagcaccaugcccgagaccauccuggagcugaccgacgcgcucgcccuggggaugauggugcugaagaucgugcgcaacauggagaaguaccagcucgccgucacgaucauggccaucuccugcgugccgaacgccgugauccugcagaacgcguggaaggucagcugcaccauccuggccgccguguccgucagcccccuccugcugaccuccagccagcagaaggccgacuggaucccccucgcgcugaccaucaagggccugaaccccacggccaucuuccucaccacccugucccggaccagcaagaagcgcuccuggccgcugaacgaggccaucauggccgugggcauggugagcauccucgccuccagccugcugaagaacgacauccccaugacggggccccucgucgcgggcgggcugcugaccgugugcuacgugcucaccggccggagcgccgaccuggagcuggagcgcgccgccgacgucaagugggaggaccaggccgagaucuccgggagcucccccauccucagcaucaccaucuccgaggacggcagcauguccaucaagaacgaggaggaggagcagacgcugaccauccugauccggaccggccuccuggugaucagcgggguguucccggucuccauccccaucaccgcggccgccugguaccugugggaggugaagaagcagcgcgccggcgugcucugggacguccccagcccgccgcccguggggaaggccgagcuggaggacggcgcguaccggaucaagcagcgcgggauccugggcuacucccagaucggcgccgggguguacaaggagggcaccuuccacacgauguggcacgucacccgcggggccgugcucaugcaccgcggcaagcggaucgagcccagcugggccgacgugaagaaggaccugaucuccuacgggggcggcuggaagcuggagggggaguggaaggagggcgaggagguccaggugcucgcccuggagcccgggaagaacccccgcgcggugcagaccaagcccggcaucuucaagaccaacacggggaccaucggcgccgucagccuggacuucucccccggcaccagcgggucccccaucguggaccggaagggcaagguggucgggcucuacggcaacggcguggugacccgcagcggggccuacgucuccgccaucgcgcagacggagaaguccaucgaggacaaccccgagaucgaggacgacaucuuccggaagaagcgccugaccaucauggaccugcaccccggcgccgggaagaccaagcgguaccuccccgccaucgugcgcgaggccaucaaccggggccugcgcacccugauccuggccccgacgcgcguggucgcggccgagauggaggaggcccuccgggggcugcccauccgcuaccagacccccgccauccgggccgagcacaccggccgcgagaucguggaccugaugugccacgcgaccuucacgaugcggcuccugagccccgugcgcgucccgaacuacaaccugaucaucauggacgaggcccacuucaccgaccccgccuccaucgccgcccggggcuacaucagcacccgcguggagaugggggaggcggccggcaucuucaugaccgccacgccgcccgggucccgggacccguucccccagagcaacgcccccaucauggacgaggagcgcgagauccccgagcgguccuggaacagcggccacgagugggugaccgacuucaaggggaagaccgucugguucgugccguccaucaaggcgggcaacgacaucgccgccugccuccgcaagaacggcaagaaggugauccagcugagccggaagaccuucgacuccgaguacgucaagacgcgcgccaacgacugggacuucguggugaccaccgacaucagcgagaugggggccaacuucaaggcggagcgggucaucgacccccgccggugcaugaagcccgugauccugaccgacggcgaggagcgcgugauccucgccgggcccaugccggucacgcacuccagcgccgcccagcggcgcggccgcaucgggcggaaccccaagaacgagaacgaccaguacaucuacaugggcgagccccuggagaacgacgaggacugcgcccacuggaaggaggcgaagaugcugcucgacaacaucaacacccccgagggcaucaucccguccauguucgagcccgagcgcgagaagguggacgccaucgacggggaguaccggcugcgcggcgaggcccggaagaccuucguggaccugaugcgccgcggggaccuccccgucuggcuggccuacaagguggccgcggagggcaucaacuacgccgaccgcaaguggugcuucgacgggaucaagaacaaccagauccuggaggagaacguggaggucgagaucuggaccaaggagggcgagcggaagaagcucaagccgcgcuggcuggacgcccggaucuacagcgacccccuggcccucaaggaguucaaggaguucgcggccggccgcaagucccugacgcugaaccucaucaccgagauggggcggcugcccaccuucaugacccagaaggcccgcaacgcccuggacaaccucgccgugcugcacacggcggaggccggcgggcgggccuacaaccacgcccugagcgagcuccccgagacccuggagacccugcuccugcugacccuccuggccacggucaccggcggcaucuuccuguuccucauguccgggaagggcaucgggaagaugacccugggcaugugcugcaucaucaccgcgagcucccugcucugguacgcccagauccagccgcacuggaucgccgccagcaucauccuggaguucuuccugaucgugcuccugauccccgagcccgagaagcagcgcacgccccaggacaaccagcugacguacguggucaucgccauccucaccgugguggcggccaccauggccaacgagaugggguuccuggagaagaccaagaaggaccugggccucggcagcaucacgacccaggaguccgagagcaacauccuggacaucgaccugcggccggccuccgccuggacccucuacgcggucgccaccacguucgugacccccaugcugcgccacagcaucgagaacuccagcgugaacgucucccugaccgccaucgccaaccaggcgaccgugcucauggggcugggcaagggguggccccugagcaagauggacaucggcgugccccuccuggccaucgggugcuacucccaggucaacccgaucacgcugaccgccgcccuccugcugcucguggcccacuacgcgaucaucggccccggccugcaggccaaggccacccgggaggcccagaagcgcgccgcggccgggaucaugaagaaccccaccguggacggcaucacggucaucgaccuggagcccaucccguacgaccccaaguucgagaagcagcucgggcaggucaugcugcugauccucugcgugacccagguccugaugaugcggaccaccugggcccugugcgaggcccucacgcuggccaccggccccaucagcacccugugggaggggaaccccggccgcuucuggaacaccacgaucgcgguguccauggccaacaucuuccgcggcagcuaccucgccggggccggccugcuguucuccaucaugaagaacaccaccaacacccggcgcgggacgggcaacaucggcgagacccucggggagaaguggaagucccggcugaacgcgcugggcaaguccgaguuccagaucuacaagaaguccgggauccaggagguggaccgcacccucgccaaggagggcaucaagcgcggggagaccgaccaccacgccgucucccgcggcagcgccaagcugcggugguucguggagcgcaacauggugacgccggagggcaaggucguggaccuggggugcggccgcggcgggugguccuacuacugcggcgggcucaagaacgugcgcgaggucaaggggcugaccaagggcggccccgggcacgaggagcccauccccaugagcaccuacggcuggaaccuggugcggcuccagagcgggguggacgucuucuucaccccgcccgagaagugcgacacgcugcugugcgacaucggcgaguccagccccaaccccaccaucgaggccggccgcacccuccgggugcugaaccugguggagaacuggcucaacaacaacacccaguucugcaucaagguccugaacccguacaugcccuccgugaucgagaagauggagacccugcagcgcaaguacgggggcgcgcucgugcggaacccccugagccgcaacuccacgcacgagauguacugggucagcaacgccaccgggaacaucguguccagcgugaacaugaucucccggaugcugaucaaccgcuucaccaugaagcacaagaaggccaccuacgagccggacgucgaccugggcagcgggacgcggaacaucggcaucgaguccgagauccccaaccucgacaucaucggcaagcgcaucgagaagaucaagcaggagcacgagaccagcuggcacuacgaccaggaccaccccuacaagaccugggccuaccacggguccuacgagaccaagcagacgggcagcgccuccagcauggugaacggggugguccgccugcugaccaagcccugggacguggugccgauggucacccagauggcgaugaccgacacgacccccuucggccagcagcggguguucaaggagaagguggacacccgcacccaggagcccaaggagggcacgaagaagcucaugaagaucaccgccgaguggcuguggaaggagcuggggaagaagaagacgccccggaugugcacccgcgaggaguucacgcggaagguccgcuccaacgccgcccucggcgccaucuucaccgacgagaacaaguggaaguccgcgcgggaggccguggaggacgggcgcuucugggagcugguggaccgggagcgcaaccugcaccucgagggcaagugcgagaccugcgucuacaacaugauggggaagcgggagaagaagcugggcgaguucggcaaggccaaggggucccgcgccaucugguacauguggcugggcgcgcgguuccucgaguucgaggcccugggguuccugaacgaggaccacugguucagccgcggcaacagccucuccgggguggagggcgagggccugcaccggcugggguacauccuccgcgaggucggcaagaaggagggcggcgccauguacgccgacgacaccgccgggugggacacgcggaucacccuggaggaccugaagaacgaggagauggugaccaaccacaugaagggcgagcacaagaagcucgcggaggccaucuucaagcugaccuaccagaacaaggugguccgcgugcagcggccgacgccccgcggcaccgugauggacaucaucagccggcgcgaccagcgcggguccggccaggucgggaccuacggccugaacaccuucacgaacauggaggcccagcucauccggcagauggagggcgaggggaucuucaagagcauccagcaccugaccgccaccgaggagaucgccgugcagaacuggcuggcgcgcgugggccgggagcgccucucccggauggccaucagcggggacgacugcgucgugaagcccaucgacgaccgcuucgccuccgcccugaccgcccugaacgacaugggcaaggugcggaaggacauccagcagugggagcccagccgcggguggaacgacuggacgcaggucccguucugcucccaccacuuccacgagcucgugaugaaggacggccgggugcuggucgugcccugccgcaaccaggacgagcugaucggccgggcgcgcaucagccagggggccggcuggucccucaaggagaccgccugccugggcaagagcuacgcccagauguggacccugauguacuuccaccggcgcgaccuccggcuggccgcgaacgccaucugcuccgccgugcccagccacuggguccccaccucccgcaccacguggagcauccacgccaagcacgaguggaugaccaccgaggacaugcuggcgguguggaaccggguguggauccaggagaacccguggauggaggacaagacccccgucgaguccugggaggaggugcccuaccucggcaagcgcgaggaccaguggugcgggagccugaucggccugacgagccgggccaccugggccaagaacauccagaccgccaucaaccaggugcgcucccucaucggcaacgaggaguacaccgacuacaugcccagcaugaagcgcuuccggcgcgaggaggaggaggccgggguccugugguga

SEQ ID NO: 9798 - RNA, 9876 nt, Artificial Sequence
  derived and/or modified CDS sequence (opt1) from DENV-2__AF208496__SS-prME
accgccggcgugaucgucaugcugauccccaccgccauggcguuccaccucaccacccggaacggggagccgcacaugaucgugggccggcaggagaaggggaagucccugcuguucaagaccgaggacggcgugaacaugugcacccucauggccaucgaccugggggagcugugcgaggacaccaucaccuacaagugccccuuccuccggcagaacgagcccgaggacaucgacugcuggugcaacuucaccuccaccugggucaccuacgggaccugcaccaccacgggcgagcaccggcgcgagaagcggagcguggcccuggugccccacgucgggaugggccuggagacccggaccgagaccuggauguccagcgagggggccuggaagcacgugcagcggaucgagacguggauccuccgccacccgggcuucaccaucauggccgcgauccuggccuacaccaucgggaccacgcacuuccagcgggcccugaucuucauccuccugaccgccguggcgcccuccaugaccaugcggugcaucggcaucuccaaccgggacuucgucgagggcguguccgggggcagcuggguggacaucguccuggagcacggguccugcgugaccacgauggccaagaacaagcccacccucgacuucgagcugaucaagaccgaggccaagcagcccgccacccugcgcaaguacugcaucgaggccaagcucacgaacaccaccaccgagagccggugcccgacgcagggcgagcccucccugaacgaggagcaggacaagcgcuucaucugcaagcacagcaugguggaccggggcugggggaacggcugcgggcuguucggcaagggcgggaucgugaccugcgcgauguucacgugcaagaagaacauggagggcaagguggugcagcccgagaaccucgaguacaccaucgucaucacgccccacuccggggaggagcacgccgugggcaacgacaccgggaagcacggcaaggagaucaagaucaccccgcagagcuccaucaccgaggccgagcugaccggguacggcacggugaccauggagugcagcccccgcaccggccuggacuucaacgagaugguccuccugcagauggaggacaaggccuggcuggugcaccggcagugguuccucgaccugccccugcccuggcucccgggggccgacacccagggcuccaacuggauccagaaggagacgcuggugaccuucaagaacccccacgcgaagaagcaggacgucgugguccuggggagccaggagggcgccaugcacaccgcccucaccggggccacggagauccagauguccagcggcaaccugcuguucaccggccaccucaagugccgccugcggauggacaagcugcagcucaaggggaugagcuacuccaugugcaccggcaaguucaagaucgugaaggagaucgccgagacccagcacgggacgaucgugauccgcguccaguacgagggcgacggcagccccugcaagauccccuucgagaucaccgaccuggagaagcggcacgugcuggggcgccucaucaccgugaacccgaucgucaccgagaaggacucccccgugaacaucgaggcggagccgcccuucggcgacagcuacaucaucaucgggguggagccgggccagcugaagcugaacugguucaagaagggguccagcaucggccagauguucgagacgaccaugcgcggcgccaagcggauggccauccucggggacaccgccugggacuucggcucccucggcggggucuucaccagcaucgggaaggcccugcaccagguguucggggcgaucuacggcgccgccuucuccggggugagcuggacgaugaagauccucaucggcgucaucaucaccuggaucgggaugaacucccgcagcaccucccugagcgugucccuggugcuggucggcguggugacccucuaccugggggccaugguccaggcggacagcggcugcgugguguccuggaagaacaaggagcugaagugcggcagcgggaucuucaucacggacaacguccacaccuggaccgagcaguacaaguuccagcccgagucccccagcaagcucgccagcgccauccagaaggcccacgaggagggcaucugcgggauccgguccgugacccgccuggagaaccugauguggaagcagaucacgcccgagcucaaccacauccugagcgagaacgaggugaagcugaccaucaugaccggcgacaucaaggggaucaugcaggccggcaagcggucccuccgcccgcagcccaccgagcugaaguacagcuggaagacguggggcaaggcgaagaugcuguccaccgagagccacaaccagaccuuccucaucgacgggcccgagaccgccgagugcccgaacacgaaccgggccuggaacucccuggaggucgaggacuacggcuucgggguguucaccaccaacaucuggcugaagcuccgcgagaagcaggacguguucugcgacagcaagcugauguccgccgccaucaaggacaaccgggcgguccacgccgacaugggcuacuggaucgagagcgcccugaacgacaccuggaagauggagaaggccuccuucaucgaggucaagagcugccacuggcccaagucccacacccucuggagcaacggcgugcuggaguccgagaugaucauccccaagaacuucgccgggcccgugagccagcacaacuaccgcccgggcuaccacacgcagaccgcggggcccuggcaccugggcaagcucgagauggacuucgacuucugcgaggggaccaccgugguggucacggaggacugcggcaaccggggccccucccugcgcaccaccaccgccagcgggaagcugaucacggaguggugcugccggagcugcacccugccgccccugcgcuaccggggcgaggacgggugcugguacggcauggagauccgcccccugaaggagaaggaggagaaccucgugaacucccuggugaccgccgggcacggccagaucgacaacuucagccugggcguccucgggauggcccuguuccuggaggagaugcuccggacccgcgugggcacgaagcacgcgauccugcugguggccgucuccuucgugacccucaucaccgggaacaugagcuuccgggaccugggccgcgugauggucauggugggggccaccaugacggacgacaucggcaugggcgugaccuaccuggcccuccuggccgcguucaagguccgccccaccuucgccgccgggcugcuccugcggaagcugaccuccaaggagcucaugauggccacgaucggcaucgcccugcugagccaguccaccaugcccgagaccauccucgagcugaccgacgcgcuggcccucgggaugauggugcugaagaucgugcgcaacauggagaaguaccagcuggccgucacgaucauggccaucagcugcgugcccaacgccgugauccuccagaacgcguggaaggucuccugcaccauccuggccgccgugagcgucagcccccugcuccugaccagcucccagcagaaggccgacuggaucccccuggcgcucaccaucaagggccugaaccccacggccaucuuccugaccacccucagccggaccuccaagaagcgcagcuggccgcugaacgaggccaucauggccgugggcaugguguccauccuggccagcucccuccugaagaacgacauccccaugacggggccccuggucgcgggcgggcuccugaccgugugcuacgugcugaccggccggagcgccgaccucgagcuggagcgcgccgccgacgucaagugggaggaccaggccgagaucagcggguccagccccauccuguccaucaccaucagcgaggacggcuccaugagcaucaagaacgaggaggaggagcagacgcucaccauccugauccggaccggccugcucgugaucuccgggguguucccggucagcauccccaucaccgcggccgccugguaccugugggaggugaagaagcagcgcgccggcgugcugugggacguccccagcccgccgcccguggggaaggccgagcucgaggacggcgcguaccggaucaagcagcgcgggauccugggcuacagccagaucggcgccgggguguacaaggagggcaccuuccacacgauguggcacgucacccgcggggccgugcugaugcaccgcggcaagcggaucgagcccuccugggccgacgugaagaaggaccucaucagcuacgggggcggcuggaagcuggagggggaguggaaggagggcgaggagguccaggugcuggcccucgagcccgggaagaacccccgcgcggugcagaccaagcccggcaucuucaagaccaacacggggaccaucggcgccgucucccuggacuucagccccggcaccuccgggagccccaucguggaccggaagggcaagguggucgggcuguacggcaacggcguggugacccgcuccggggccuacgucagcgccaucgcgcagacggagaaguccaucgaggacaaccccgagaucgaggacgacaucuuccggaagaagcgccucaccaucauggaccugcaccccggcgccgggaagaccaagcgguaccugcccgccaucgugcgcgaggccaucaagcggggccuccgcacccugauccuggccccgacgcgcguggucgcggccgagauggaggaggcccugcgggggcuccccauccgcuaccagacccccgccauccgggccgagcacaccggccgcgagaucguggaccugaugugccacgcgaccuucacgaugcggcugcucagccccgugcgcgucccgaacuacaaccugaucaucauggacgaggcccacuucaccgaccccgccagcaucgccgcccggggcuacaucuccacccgcguggagaugggggaggcggccggcaucuucaugaccgccacgccgcccgggagccgggacccguucccccaguccaacgcccccaucauggacgaggagcgcgagauccccgagcggagcuggaacuccggccacgagugggugaccgacuucaaggggaagaccgucugguucgugccgagcaucaaggcgggcaacgacaucgccgccugccugcgcaagaacggcaagaaggugauccagcucucccggaagaccuucgacagcgaguacgucaagacgcgcgccaacgacugggacuucguggugaccaccgacaucuccgagaugggggccaacuucaaggcggagcgggucaucgacccccgccggugcaugaagcccgugauccugaccgacggcgaggagcgcgugauccuggccgggcccaugccggucacgcacagcuccgccgcccagcggcgcggccgcaucgggcggaaccccaagaacgagaacgaccaguacaucuacaugggcgagccccucgagaacgacgaggacugcgcccacuggaaggaggcgaagaugcugcuggacaacaucaacacccccgagggcaucaucccgagcauguucgagcccgagcgcgagaagguggacgccaucgacggggaguaccggcuccgcggcgaggcccggaagaccuucguggaccugaugcgccgcggggaccugcccgucuggcucgccuacaagguggccgcggagggcaucaacuacgccgaccgcaaguggugcuucgacgggaucaagaacaaccagauccuggaggagaacguggaggucgagaucuggaccaaggagggcgagcggaagaagcugaagccgcgcuggcucgacgcccggaucuacuccgacccccuggcccugaaggaguucaaggaguucgcggccggccgcaagagccucacgcugaaccugaucaccgagauggggcggcuccccaccuucaugacccagaaggcccgcaacgcccuggacaaccuggccgugcuccacacggcggaggccggcgggcgggccuacaaccacgcccuguccgagcugcccgagacccucgagacccugcugcuccugacccugcucgccacggucaccggcggcaucuuccuguuccugaugagcgggaagggcaucgggaagaugacccucggcaugugcugcaucaucaccgcguccagccugcugugguacgcccagauccagccgcacuggaucgccgccuccaucauccucgaguucuuccugaucgugcugcucauccccgagcccgagaagcagcgcacgccccaggacaaccagcugacguacguggucaucgccauccugaccgugguggcggccaccauggccaacgagaugggguuccucgagaagaccaagaaggaccugggccugggcagcaucgccacgcaggagagcgaguccaacauccucgacaucgaccugcggccggccagcgcguggacccuguacgccgucgccaccaccuucgugacgcccaugcuccgccacuccaucgagaacagcuccgugaacgucagccugaccgccaucgcgaaccaggccaccgugcugauggggcucggcaagggguggccccuguccaagauggacaucggcgugccccugcucgccaucgggugcuacagccaggucaacccgaucacccugacggccgcccugcuccugcugguggcgcacuacgccaucaucggccccggccuccaggccaaggccacccgggaggcccagaagcgcgcggccgccgggaucaugaagaaccccaccguggacggcaucaccgucaucgaccuggagcccaucccguacgaccccaaguucgagaagcagcuggggcaggucaugcuccugauccugugcgugacgcagguccucaugaugcggaccaccugggcccugugcgaggcccugacccucgcgacgggccccaucuccacccugugggaggggaaccccggccgcuucuggaacaccaccaucgccgugagcauggccaacaucuuccgcggcuccuaccuggccggggcgggccuccuguucagcaucaugaagaacacgaccaacacccggcgcgggaccggcaacaucggcgagacgcugggggagaaguggaagucccggcucaacgcccugggcaagagcgaguuccagaucuacaagaaguccgggauccaggagguggaccgcacccuggccaaggagggcaucaagcgcggggagaccgaccaccacgccgucagccgcggcuccgccaagcuccggugguucguggagcgcaacauggugaccccggagggcaaggucguggaccuggggugcggccgcgggggcuggagcuacuacugcgggggccugaagaacgugcgcgaggucaagggccucacgaagggcggccccgggcacgaggagcccauccccauguccaccuacggcuggaaccuggugcggcugcagagcgggguggacgucuucuucaccccgcccgagaagugcgacacccuccugugcgacaucggcgagagcucccccaaccccacgaucgaggcgggccgcacccugcgggugcucaaccugguggagaacuggcugaacaacaacacccaguucugcaucaagguccucaacccguacaugcccagcgugaucgagaagauggagacccugcagcgcaaguacgggggcgcccuggugcggaacccccucucccgcaacagcacccacgagauguacugggucuccaacgccacggggaacaucgugagcuccgugaacaugaucagccggaugcugaucaaccgcuucaccaugaagcacaagaaggccaccuacgagccggacgucgaccugggcuccgggacccggaacaucggcaucgagagcgagauccccaaccuggacaucaucggcaagcgcaucgagaagaucaagcaggagcacgagacguccuggcacuacgaccaggaccaccccuacaagaccugggccuaccacgggagcuacgagaccaagcagaccggcuccgcgagcuccauggugaacggggugguccgccuccugacgaagcccugggacguggugccgauggucacccagauggccaugaccgacaccacgcccuucggccagcagcggguguucaaggagaagguggacacccgcacccaggagcccaaggagggcaccaagaagcugaugaagaucacggccgaguggcucuggaaggagcuggggaagaagaagacgccccggaugugcacccgcgaggaguucacccggaagguccgcagcaacgccgcccugggcgcgaucuucacggacgagaacaaguggaaguccgcccgggaggccguggaggacgggcgcuucugggagcucguggaccgggagcgcaaccugcaccuggagggcaagugcgagaccugcgucuacaacaugauggggaagcgggagaagaagcucggcgaguucggcaaggccaaggggagccgcgcgaucugguacauguggcugggcgcccgguuccuggaguucgaggcccucggguuccugaacgaggaccacugguucucccgcggcaacagccugagcgggguggagggcgagggccuccaccggcugggguacauccugcgcgaggucggcaagaaggagggcggcgccauguacgccgacgacaccgcggggugggacacccggaucacgcucgaggaccugaagaacgaggagauggugaccaaccacaugaagggcgagcacaagaagcuggccgaggccaucuucaagcucaccuaccagaacaaggugguccgcgugcagcggccgacgccccgcggcaccgugauggacaucaucucccggcgcgaccagcgcgggagcggccaggucgggaccuacggccugaacaccuucaccaacauggaggcccagcugauccggcagauggagggcgaggggaucuucaaguccauccagcaccucacggccaccgaggagaucgcggugcagaacuggcuggcccgcgugggccgggagcgccugagccggauggccaucuccggggacgacugcgucgugaagcccaucgacgaccgcuucgccagcgcccucaccgcgcugaacgacaugggcaaggugcggaaggacauccagcagugggagcccucccgcggguggaacgacuggacccaggucccguucugcagccaccacuuccacgagcuggugaugaaggacggccgggugcucgucgugcccugccgcaaccaggacgagcugaucggccgggcccgcaucucccagggggccggcuggagccugaaggagacggccugccucgggaaguccuacgcccagauguggacccugauguacuuccacaagcgggaccugcgccucgcggccaacgccaucugcagcgccgugcccucccacuggguccccaccagccggaccaccugguccauccacgcgaagcacgaguggaugacgaccgaggacaugcuggccguguggaaccgcguguggauccaggagaacccguggauggaggacaagacccccgucgagagcugggaggaggugcccuaccugggcaagcgggaggaccaguggugcgggucccucaucggccugaccagccgcgccacgugggccaagaacauccagaccgccaucaaccaggugcggagccugaucggcaacgaggaguacaccgacuacaugcccuccaugaagcgcuuccgccgggaggaggaggaggcggggguccucugguga

SEQ ID NO: 9799 - RNA, 9876 nt, Artificial Sequence
  derived and/or modified CDS sequence (opt1) from DENV-2__AY702040__SS-prME
accgcgggcaugaucaucaugcugauccccaccgugauggccuuccaccucaccacccggaacggggagccccacaugaucgugagccggcaggagaagggcaagagccugcuguucaagaccaaggacgggaccaacaugugcacccucauggcgauggaccugggcgagcugugcgaggacaccaucaccuacaagugccccuuccucaagcagaacgagcccgaggacaucgacugcuggugcaacagcaccuccacgugggugaccuacgggaccugcaccacgaccggcgagcaccgccgggagaagcgcagcguggcccuggucccccacgugggcauggggcuggagacccggaccgagacguggauguccagcgagggcgccuggaagcacgcccagcgcaucgagaccuggauccuccggcaccccggguucaccaucauggccgcgauccuggccuacaccaucggcacgacccacuuccagcgcgugcugaucuucauccuccugaccgccaucgcccccuccaugaccaugcggugcaucgggaucagcaaccgcgacuucgucgagggcguguccggcgggagcuggguggacaucguccuggagcacggcuccugcgugacgaccauggcgaagaacaagcccacccucgacuucgagcugaucaagaccgaggccaagcagcccgccacgcugcggaaguacugcaucgaggccaagcucaccaacaccaccacggacagccgcugcccgacccagggggagcccacccugaacgaggagcaggacaagcgguucgugugcaagcacuccauggucgaccgcggcuggggcaacgggugcggccuguucgggaagggcgggaucgugaccugcgccauguucacgugcaagaagaacauggagggcaagaucgugcagcccgagaaccucgaguacaccgucgugaucacgccccacagcggcgaggagcacgcgguggggaacgacaccggcaagcacgggaaggaggucaagaucaccccgcaguccagcaucacggaggccgagcugaccggcuacgggaccgugaccauggagugcagcccccggacgggccuggacuucaacgagauggugcuccugcagauggaggacaaggccuggcugguccaccgccagugguuccucgaccugccccugcccuggcucccgggcgccgacacccaggggagcaacuggauccagaaggagacccuggugaccuucaagaacccccacgccaagaagcaggacguggucgugcugggcucccaggagggggcgaugcacacggcccucaccggcgccaccgagauccagaugagcagcgggaaccugcuguucaccggccaccucaagugccggcugcgcauggacaagcugcagcucaagggcauguccuacagcaugugcacggggaaguucaagaucgucaaggagaucgccgagacccagcacggcaccaucgugauccgggugcaguacgagggggacggcucccccugcaagauccccuucgagaucauggaccuggagaagcgccacguccugggccggcucaucaccgugaacccgaucgugacggagaaggacagccccgucaacaucgaggccgagccgcccuucggggacuccuacaucaucaucggcguggagccggggcagcugaagcuggacugguucaagaagggcagcuccaucgggcagauguucgagaccaccaugcgcggcgcgaagcgcauggccauccucggcgacaccgccugggacuucgggagccugggcgggguguucacguccaucggcaaggcccugcaccaggucuucggggccaucuacggcgcggccuucagcggcguguccuggaccaugaagauccucaucggggugaucaucaccuggaucggcaugaacagccgguccaccagccuguccgucagccuggugcugguggggaucgucacgcucuaccugggcgugauggugcaggccgacuccgggugcgucgugagcuggaagaacaaggagcugaagugcggcuccggcaucuucgugaccgacaacguccacaccuggaccgagcaguacaaguuccagcccgagagccccagcaagcucgccuccgcgauccagaaggcccacgaggaggggaucugcggcauccgcagcgugacgcggcuggagaaccugauguggaagcagaucaccuccgagcucaaccacauccugagcgagaacgaggugaagcugaccaucaugaccggggacaucaagggcaucaugcaggucgggaagcgcucccuccggccccagccgacggagcugcgcuacagcuggaagaccuggggcaaggccaagaugcuguccaccgagcuccacaaccagaccuuccugaucgacggccccgagacggccgagugccccaacaccaaccgggccuggaacagccuggagguggaggacuacggguucggcguguucaccaccaacaucuggcuccgccugcgggagaagcaggacgcguucugcgacccgaagcugauguccgccgccaucaaggacaaccgcgccguccacgccgacaugggguacuggaucgagagcgcgcucaacgacaccuggaagaucgagaaggccuccuucaucgaggugaaguccugccacuggcccaagucccacacgcuguggagcaacggcgugcuggaguccgagauggucauccccaagaacuucgccggccccgugagccagcacaacaaccggccgggguaccacacccagaccgccggccccuggcaccucgggaagcuggagauggacuucgacuucugcgagggcaccacgguggucgugaccgaggagugcgggaaccgcggccccucccugcggaccaccacggccagcggcaagcucaucaccgaguggugcugccgcagcugcacccugcccccgcugcgguaccgcggggaggacggcugcugguacgggauggagauccggccccucaaggagaaggaggagaaccugguguccagccuggucaccgcgggccacgggcagaucgacaacuucucccucggcauccugggcauggcccuguuccucgaggagaugcugcgcacgcggguggggaccaagcacgccauccugcucguggccgucagcuucgugacccugaucaccggcaacauguccuuccgcgaccuggggcgcgugauggucauggugggcgcgacgaugaccgacgacaucgggaugggcgugaccuaccucgcccugcuggccgccuucaagguccggcccaccuucgccgcgggccuccugcugcgcaagcucacgagcaaggagcugaugaugaccaccaucgggaucgugcugcucucccagagcuccauccccgagaccauccuggagcugacggacgcccucgcccugggcaugauggugcugaagaugguccggaacauggagaaguaccagcucgccgugaccaucauggccauccugugcgugccgaacgcggucauccugcagaacgccuggaaggugagcugcaccauccucgccgucguguccgugagcccccugcugcucaccuccagccagcagaaggccgacuggaucccccuggcccugacgaucaaggggcucaaccccaccgcgaucuuccugaccacccugucccgcacgagcaagaagcgguccuggccgcucaacgaggccaucauggccgucggcauggugagcauccuggccuccagccugcucaagaacgacauccccaugaccggcccccugguggccggcgggcugcucaccgucugcuacgugcugaccgggcgcagcgccgaccuggagcucgagcgggccacggacgugaagugggacgaccaggccgagaucuccgggagcucccccauccugagcaucaucaucuccgaggacgggagcauguccaucaagaacgaggaggaggagcagacccugaccauccucauccgcaccggccugcuggucaucagcggccucuucccgguguccauccccaucaccgccgcggccugguaccugugggaggugaagaagcagcgggccgggguccugugggacgugcccagcccgccgcccgugggccgcgccgagcucgaggacggggccuaccggaucaagcagaagggcauccugggguacucccagaucggcgcgggcgucuacaaggaggggacguuccacaccauguggcacgugacccgcggcgccgugcugaugcacaaggggaagcggaucgagcccagcugggccgacgucaagaaggaccucaucuccuacggcgggggcuggaagcuggagggcgaguggaaggagggggaggagguccaggugcuggcccucgagcccggcaagaacccccgcgccguccagaccaagcccgggcuguuccggacgaacaccggcaccaucggggcggugagccuggacuucucccccggcaccagcggcucccccaucguggacaagaaggggaaggucgugggccucuacgggaacggcguggucacgcgcggcggggccuacgugagcgccaucgcccagaccgagaaguccaucgaggacaaccccgagaucgaggacgacaucuuccggaagcgccggcugaccaucauggaccugcaccccggcgccgggaagaccaagcgcuaccugcccgcgaucgugcgggaggccaucaagcgcggccuccgcacgcugauccuggccccgacccgggucguggccgcggagauggaggaggcccuccgcgggcugcccauccgguaccagacccccgccauccgcgccgagcacaccggccgggagaucguggaccugaugugccacgccacguucaccaugcgccuccugagccccauccgggucccgaacuacaaccugaucaucauggacgaggcgcacuucaccgaccccgccagcaucgccgcccgcggcuacaucuccacccggguggagaugggggaggccgcgggcaucuucaugacggccacgccgcccgggagccgcgacccguucccccaguccaacgcccccaucauggacgaggagcgggagauccccgagcgcagcuggaacuccggccacgagugggugaccgacuucaaggggaagaccgucugguucgugccgagcaucaagacgggcaacgacaucgccgccugccuccggaagaacggcaagcgcgugauccagcugucccggaagaccuucgacagcgaguacgucaagacccgcaccaacgacugggacuucguggugacgaccgacaucuccgagaugggggcgaacuucaaggccgagcgggucaucgacccccgccggugcaugaagcccgugauccugaccgacggcgaggagcgcgugauccucgccgggcccaugccggucacccacagcuccgccgcgcagcgccggggccgcaucgggcggaacccccgcaacgagaacgaccaguacaucuacaugggcgagccccuggagaacgacgaggacugcgcccacuggaaggaggccaagaugcugcucgacaacaucaacacgcccgagggcaucaucccgagcauguucgagcccgagcgggagaagguggacgccaucgacggggaguaccgccugcggggcgaggcccgcaagaccuucguggaccugaugcggcgcggggaccuccccgucuggcuggcguacaagguggccgccgagggcaucaacuacgccgaccggcgcuggugcuucgacgggacccggaacaaccagauccuggaggagaacguggaggucgagaucuggaccaaggagggcgagcgcaagaagcucaagccgcgguggcuggacgcccgcaucuacuccgacccccuggcgcucaaggaguucaaggaguucgccgccggccgcaagagccugacgcugaaccucaucaccgagauggggcgccugcccaccuucaugacccagaaggcccgggacgcccuggacaaccucgcggugcugcacacggccgaggccggcgggaaggccuacaaccacgcgcuguccgagcuccccgagacccuggagacccugcuccugcugacccuccuggccaccgucacgggcggcaucuuccuguuccucaugagcgggcgcggcaucgggaagaugacccugggcaugugcugcaucaucaccgccuccauccugcucugguacgcccagauccagccgcacuggaucgccgcgagcaucauccuggaguucuuccugaucgugcuccugauccccgagcccgagaagcagcggacgccccaggacaaccagcugacguacgugaucaucgccauccucaccgucguggccgccaccauggccaacgagaugggguuccuggagaagaccaagaaggacuucggccugggccacaucgcgacgcagcagccggaguccaacauccucgacaucgaccugcgccccgccagcgccuggacccuguacgccguggccaccaccuucaucacgcccaugcuccgccacagcaucgagaacuccagcgucaacgugucccugaccgcgaucgccaaccaggccaccgugcugauggggcucggcaagggguggccccugagcaagauggacaucggcgucccgcugcucgccaucgggugcuacucccaggugaaccccaucacccugacggccgcgcugcuccugcugguggcccacuacgccaucaucggccccggccuccaggccaaggcgacccgggaggcccagaagcgcgccgccgccgggaucaugaagaaccccaccgucgacggcaucaccgugaucgaccuggacccgauccccuacgaccccaaguucgagaagcagcugggccaggugaugcuccugguccugugcgugacccaggugcucaugaugcggaccaccugggcgcugugcgaggcccugacccucgccacgggccccgucagcacccugugggaggggaacccgggccgcuucuggaacaccaccaucgccguguccauggccaacaucuuccggggcagcuaccuggcgggggccggccuccuguucuccaucaugaagaacacgaccagcgcccgccgggggaccggcaacaugggcgagacccugggggagaaguggaagucccgccucaacgcccugggcaagagcgaguuccagaucuacaagaaguccgggauccaggagguggaccggacgcuggccaaggagggcaucaagcgcggggagaccgaccaccacgcggucagccggggcuccgccaagcuccgcugguucguggagcggaaccuggugacccccgagggcaaggucguggaccuggggugcggccgcgggggcuggagcuacuacugcgggggccucaagaacgugcgggaggucaagggccugaccaagggcgggcccgggcacgaggagcccaucccgauguccacguacggcuggaaccuggugcgccuccagagcgggguggacgucuucuucgugccgcccgagaagugcgacacccugcugugcgacaucggcgaguccagccccaacccgaccguggaggccggccggacccuccgcguccugaaccugguggagaacuggcucaacaacaacacccaguucugcgugaagguccugaaccccuacaugcccagcgugaucgagcggauggagacgcugcagcgcaaguacgggggcgcccuggugcgcaacccgcucucccggaacagcacccacgagauguacugggucuccaacgcgagcgggaacaucguguccagcgugaacaugaucucccgcaugcugaucaaccgguucaccaugcgccacaagaaggccaccuacgagcccgacgucgaccugggcagcgggacgcggaacaucggcaucgaguccgagacccccaaccucgacaucaucggcaagcgcaucgagaagaucaagcaggagcacgagaccagcuggcacuacgaccaggaccaccccuacaagaccugggccuaccacggguccuacgagacgaagcagaccggcagcgccuccagcauggugaacggggugguccggcugcugaccaagccgugggacgugauccccauggugacccagauggccaugacggacaccacccccuucggccagcagcgcgucuucaaggagaagguggacacccggacgcaggagcccaaggagggcaccaagaagcucaugaagaucaccgcggaguggcuguggaaggagcuggggaagaagaagaccccgcgcaugugcacgcgggaggaguucaccaagaaggugcgcuccaacgccgcccucggcgccaucuucaccgacgagaacaaguggaaguccgcccgggaggcggucgaggacaaccgcuucugggagcugguggacaaggagcggaaccugcaccucgaggggaagugcgagaccugcgucuacaacaugaugggcaagcgcgagaagaagcugggggaguucggcaaggccaagggcucccgggccaucugguacauguggcugggggcccgcuuccucgaguucgaggcccugggcuuccugaacgaggaccacugguucagccgggagaacucccucagcgggguggagggcgaggggcugcacaagcugggcuacauccuccgcgaggugagcaagaaggagggcggggcgauguacgccgacgacacggccggcugggacacccggaucaccaucgaggaccugaagaacgaggagaugaucaccaaccacauggccggggagcacaagaagcuggcggaggccaucuucaagcucacguaccagaacaaggucgugcgcgugcagcgccccacgccccggggcaccgucauggacaucaucucccgcaaggaccagcgggggagcggccaggugggcaccuacgggcugaacacguucaccaacauggaggcccagcugauccgccagauggagggcgaggggaucuucaaguccauccagcaccucaccgccagcgaggagaucgccgugcaggacuggcugguccgggugggccgcgagcggcugucccgcauggcgaucagcggcgacgacugcguggucaagccccucgacgaccgguucgccaaggcccugaccgcccugaacgacauggggaaggugcgcaaggacauccagcagugggagccgucccggggcuggaacgacuggacccaggugcccuucugcagccaccacuuccacgagcucaucaugaaggacgggcgcacccuggucgugcccugccggaaccaggacgagcugaucggccgcgcccggaucucccagggggcgggcuggagccuccgcgagaccgccugccugggcaaguccuacgcccagauguggagccugauguacuuccaccggcgcgaccuccggcuggccgccaacgcgaucugcuccgccgugcccagccacugggucccgaccucccgcaccacguggagcauccacgccucccacgaguggaugaccaccgaggacaugcugaccguguggaaccgcguguggauccucgagaaccccuggauggaggacaagacgcccgucgagagcugggaggagauccccuaccuggggaagcgggaggaccaguggugcggcagccugaucgggcucaccucccgcgccaccugggccaagaacauccagaccgcgaucaaccaggugcggagccugaucggcaacgaggaguacacggacuacaugccguccaugaagcgcuuccggcgcgaggaggaggaggccggggugcugugguga

SEQ ID NO: 9800 - RNA, 9876 nt, Artificial Sequence
  derived and/or modified CDS sequence (opt1) from DENV-2__AY037116__SS-prME
accgccggcaucaucaucaugaugauccccaccgugauggccuuccaccugaccacccgcaacggggagccccacaugaucgucagccggcaggagaagggcaagagccuccuguucaagaccgagaacggggugaacaugugcacccugauggcgauggaccucggcgagcugugcgaggacaccaucaccuacaacugcccccugcuccgccagaacgagcccgaggacaucgacugcgggugccacagcaccagcaccugggugaccuacgggaccugcaccgccaccggcgagcaccggcgcgagaagcggagcgucgcccuggugccccacguggggaugggccuggagacgcgcaccgagaccuggauguccagcgagggggccuggaagcacgcccagcggaucgagaccuggguccuccgccaccccggcuucacgaucauggcggccauccuggccuacaccaucgggaccaccuacuuccagcgggugcugaucuucauccuccugacggccgugacccccuccaugaccaugcgcugcaucggcaucagcaaccgggacuucgucgagggcguguccgggggcagcuggguggacaucguccuggagcacggguccugcgugaccacgauggcgaagaacaagcccacccucgacuucgagcuggugaagaccgaggccaagcaccccgccacccugcgcaaguacugcaucgaggccaagcucacgaacaccaccaccgccagccggugcccgacgcagggcgagcccucccugaacgaggagcaggacaagcgcuucgucugcaagcacagcaugguggaccggggcugggggaacggcugcgggcuguucggcaagggcgggaucgugaccugcgcgauguucacgugcaagaagaacauggagggcaaggucgugcagcccgagaaccucgaguacaccaucgugaucacgccccacuccggggaggagaacgccgucggcaacgacaccgggaagcacggcaaggagaucaaggugaccccgcagagcuccaucaccgaggccgagcugaccggguacggcacggugaccauggagugcagcccccgcaccggccuggacuucaacgagaugguccuccugcagauggagaacaaggccuggcuggugcaccggcagugguuccucgaccugccccugcccuggcucccgggggccgacacccagggcuccaacuggauccagaaggagacgcuggucaccuucaagaacccccacgcgaagaagcaggacguggugguccuggggagccaggagggcgccaugcacaccgcccucaccggggccacggagauccagaugagcuccggcaaccugcuguucaccggccaccucaagugccgccugcggauggacaagcugcagcucaaggggaugagcuacuccaugugcaccggcaaguucaagguggugaaggagaucgccgagacccagcacgggacgaucgucauccgcgugcaguacgagggcgacggcagccccugcaagauccccuucgagaucauggaccuggagaagcggcacgugcuggggcgccucaucaccgucaacccgaucgugaccgagaaggacucccccgugaacaucgaggcggagccgcccuucggcgacagcuacaucaucaucggggucgagccgggccagcugaagcuguccugguucaagaaggggagcuccaucggccagauguucgagaccacgaugcgcggcgccaagcggauggccauccucggggacaccgccugggacuucggcagccucggcgggguguucaccuccaucgggaaggcccugcaccagguguucggggcgaucuacggcgccgccuucagcggggucuccuggaccaugaagauccucaucggcguggugaucacguggaucgggaugaacagccgcuccaccagccuguccgucagccuggugcuggugggcgucgugacccucuaccugggggugaugguccaggccgacuccggcugcguggugagcuggaagaacaaggagcugaagugcggcagcgggaucuucaucaccgacaacguccacacguggaccgagcaguacaaguuccagcccgagucccccagcaagcucgcguccgccauccagaaggcccacgaggagggcaucugcgggauccggagcgugacccgccuggagaaccugauguggaagcagaucacccccgagcucaaccacauccuguccgagaacgaggugaagcugacgaucaugaccggcgacaucaaggggaucaugcaggccggcaagcggagccuccgcccgcagcccaccgagcugaaguacuccuggaaggccuggggcaaggcgaagaugcugagcaccgagcuccacaaccacacguuccugaucgacgggcccgagaccgccgagugcccgaacaccaaccgggccuggaacucccuggaggucgaggacuacggcuucgggguguucaccacgaacaucuggcucaagcugaaggagcgccaggacguguucugcgacagcaagcugauguccgccgccaucaaggacaaccgggcgguccacgccgacaugggcuacuggaucgagagcgcccucaacgacaccuggaagaucgagaaggccuccuucaucgaggucaagagcugccacuggcccaagucccacacccuguggagcaacggcgugcuggaguccgagaugaucauccccaagaacuucgccgggcccgugagccagcacaacuaccgcccgggcuaccacacccagaccgcggggcccuggcaccucggccggcuggagauggacuucgacuucugcgaggggacgaccgugguggucaccgaggacugcggcaaccgcggccccagccugcggaccacgaccgccuccgggaagcucaucaccgaguggugcugccgcagcugcacccugcccccgcugcgguaccgcggcgaggacgggugcugguacggcauggagauccggccccucaaggagaaggaggagaaccuggugaacucccuggugacggccgggcacggccagaucgacaacuucagccucggcguccuggggauggcccuguuccucgaggagaugcugcgcacccgggugggcaccaagcacgcgauccugcucguggccgucuccuucgugacccugaucacggggaacaugagcuuccgcgaccugggccgcgugauggucauggugggggccaccaugaccgacgacaucggcaugggcgugaccuaccucgcccugcuggccgcguucaagguccggcccacguucgccgccgggcuccugcugcgcaagcucaccuccaaggagcugaugaugaccaccaucggcaucgugcugcucagccaguccacgauccccgagaccauccuggagcugaccgacgccugggcccucgggaugaugguccugaagaucgugcggaacauggagaaguaccagcuggcggugaccaucauggccauccucugcgucccgaacgccgugauccugcagaacgccuggaaggugagcugcacgacccuggccgucguguccgugagcccccuccugcugaccuccagccagcagaaggcggacuggaucccccucgcccugaccaucaagggccugaaccccacggccaucuuccucaccacccugucccgcaccagcaagaagcgguccuggccgcugaacgaggccaucauggcggucggcauggugagcauccucgccuccagccugcugaagaacgacauccccaugacggggccccucguggccggcgggcugcugaccgucugcuacgugcucaccggccgcagcgccgaccuggagcuggagcgggccgcggacgugcgcugggaggagcaggccgagaucuccgggagcucccccauccucagcaucaccaucuccgaggacggcagcauguccaucaagaacgaggaggaggagcagacgcugaccauccugauccggaccggccuccuggucaucagcgggcuguucccggccuccauccccaucaccgccgccgcgugguaccucugggaggugaagaagcagcgcgccggcgugcugugggacguccccagcccgccgcccguggggaaggccgagcuggaggacggcgccuaccggaucaagcagaaggggauccucggcuacucccagaucggcgccgggguguacaaggagggcaccuuccacacgauguggcacgucacccgcggggcggugcugaugcacaagggcaagcggaucgagcccagcugggccgacgugaagaaggaccugaucuccuacgggggcggcuggaagcucgagggggaguggaaggagggcgaggagguccaggugcuggcccuggagcccgggaagaacccccgcgccgugcagaccaagcccggccucuucaagaccaacacggggaccaucggcgccgucagccuggacuucucccccggcaccagcgggucccccaucguggacaagaagggcaagguggucgggcuguacggcaacggcguggugacccggagcggggcguacgucuccgccaucgcccagacggagaaguccaucgaggacaaccccgagaucgaggacgacaucuuccgcaagaagcggcucaccaucauggaccugcaccccggcgccgggaagaccaagcgcuaccugcccgcgaucgugcgggaggccaucaagcgcggccugcggacccucauccuggccccgacgcgcguggucgccgccgagauggaggaggcgcugcgcgggcuccccauccgguaccagacccccgccauccgcgccgagcacaccggccgggagaucguggaccugaugugccacgccaccuucacgaugcgccugcucagccccauccgggugccgaacuacaaccugaucaucauggacgaggcccacuucaccgaccccgcguccaucgccgcccgcggcuacaucagcacccgggucgagaugggggaggccgccggcaucuucaugaccgcgacgccgcccgggucccgcgacccguucccccagagcaacgcccccaucauggacgaggagcgggagauccccgagcgcuccuggaacagcggccacgagugggugaccgacuucaaggggaagaccgugugguucgucccguccaucaaggccggcaacgacaucgccgcgugccugcggaagaacggcaagaaggugauccagcucagccgcaagaccuucgacuccgaguacaucaagacgcggaccaacgacugggacuucguggucaccaccgacaucagcgagaugggggccaacuucaaggccgagcgcgugaucgacccccggcgcugcaugaagcccgugauccugacggacggcgaggagcgggucauccuggccgggcccaugccggugacccacuccagcgccgcgcagcgccggggccgcguggggcgcaaccccaagaacgagaacgaccaguacaucuacaugggcgagccccucgagaacgacgaggacugcgcccacuggaaggaggccaagaugcugcuggacaacaucaacacccccgagggcaucaucccguccauguucgagcccgagcgggagaaggucgacgccaucgacggggaguaccgccuccggggcgaggcccgcaagaccuucguggaccugaugcggcgcggggaccugcccgucuggcucgcguaccggguggccgccgagggcaucaacuacgccgaccgccgguggugcuucgacggggugaagaacaaccagauccuggaggagaacgucgagguggagaucuggacgaaggagggcgagcgcaagaagcugaagccgcgguggcucgacgcccgcaucuacagcgacccccuggcgcugaaggaguucaaggaguucgccgccggccggaagucccucacccugaaccugaucaccgagauggggcgccuccccaccuucaugacgcagaaggcccggaacgcgcuggacaaccuggccgugcuccacaccgccgaggccggcgggcgcgccuacaaccacgcgcugagcgagcugcccgagacccucgagacccugcugcuccugacgcugcucgccaccgucaccggcggcaucuuccuguuccugauguccgggaagggcaucgggaagaugacccucggcaugugcugcaucaucaccgccagcauccugcugugguacgcccagauccagccgcacuggaucgccgcguccaucauccucgaguucuuccugaucgugcugcucauccccgagcccgagaagcagcggacgccccaggacaaccagcugaccuacguggucaucgccauccugaccgugguggccgccaccauggccaacgagaugggguuccucgagaagacgaagaaggacuucggccugggcagcaucgcgacccagcagccggagagcaacauccuggacaucgaccuccgccccgccuccgccuggacccuguacgccgucgccaccacguucaucacccccaugcugcggcacagcaucgagaacuccagcgugaacgugucccucaccgcgaucgccaaccaggccaccguccugauggggcugggcaagggguggccccucagcaagauggacaucggcgugccgcugcuggccaucgggugcuacucccaggugaaccccaucacgcucaccgcggcccugcugcuccuggucgcccacuacgccaucaucggccccggccugcaggccaaggcgacccgcgaggcccagaagcgggccgccgccgggaucaugaagaaccccaccguggacggcaucacggugaucgaccucgacccgauccccuacgaccccaaguucgagaagcagcuggggcaggucaugcugcucgugcugugcgugacccagguccugaugaugcgcaccaccugggcgcucugcgaggcccugacgcuggccaccggccccaucagcacccucugggaggggaacccgggccgcuucuggaacaccacgaucgccguguccauggccaacaucuuccggggcagcuaccuggcgggggccggccugcuguucuccaucaugaagaacaccgccaacacccgccgggggaccggcaacacgggcgagacccugggggagaaguggaagaaccgccugaacgcccucggcaagagcgaguuccagaucuacaagaaguccgggauccaggagguggaccggacccuggcgaaggagggcaucaagcgcggggagaccgaccaccacgccgucagccggggcuccgccaagcugcgcugguucguggagcggaaccucgugacgcccgagggcaaggucguggaccuggggugcggccgcgggggcuggagcuacuacugcgggggccugaagaacgugaaggaggucaagggccucaccaagggcggccccgggcacgaggagcccaucccgauguccaccuacggcuggaaccuggugcggcugcagagcgggguggacgucuucuucacgccgcccgagaagugcgacacgcuccugugcgacaucggcgaguccagccccaacccgaccguggaggccggccgcacccugcgggugcucaaccuggucgagaacuggcugaacaacaacacccaguucugcaucaaggugcucaaccccuacaugcccagcgugaucgagaagauggaggcccugcagcgcaaguacgggggcgcgcugguccggaacccgcugucccgcaacagcacccacgagauguacuggguguccaacgccagcgggaacaucguguccagcgucaacaugaucucccggaugcucaucaaccgcuucacgaugcggcacaagaaggccaccuacgagcccgacguggaccugggcagcgggacccgcaacaucggcaucgaguccgagacccccaaccuggacaucaucggcaagcgcaucgagaagaucaagcaggagcacgagacgagcuggcacuacgaccaggaccaccccuacaagaccugggccuaccacggguccuacgagaccaagcagaccggcagcgccuccagcauggugaacggggucgugcggcuccugacgaagccgugggacaucauccccauggugacccagauggcgaugaccgacaccacgcccuucggccagcagcgcgucuucaaggagaagguggacacccggacccaggagcccaaggagggcaccaagaagcugaugaagaucacggccgaguggcucuggaaggagcuggggaagaagaagaccccgcgcaugugcacccgggaggaguucacccgcaagguccgguccaacgccgcccugggcgccaucuucacggacgagaacaaguggaaguccgcgcgcgaggccguggaggacuccggguucugggagcucguggacaaggagcggaaccugcaccuggagggcaagugcgagaccugcgucuacaacaugauggggaagcgcgagaagaagcucggcgaguucggcaaggccaaggggagccgggccaucugguacauguggcugggcgcgcgcuuccuggaguucgaggcccucggguuccugaacgaggaccacugguucucccgggagaacagccugagcggcguggagggggagggccuccacaagcugggcuacauccugcgcgacguguccaagaaggagggcggcgccauguacgccgacgacaccgccgggugggacacccggaucacgcucgaggaccugaagaacgaggagauggucaccaaccacauggagggcgagcacaagaagcuggcggaggccaucuucaagcucaccuaccagaacaagguggugcgcguccagcggcccacgccccgcgggacggugauggacaucaucagccggcgcgaccagcggggcuccggccagguggucaccuacgggcugaacaccuucaccaacauggaggcccagcugauccgccagauggagggcgaggggguguucaagagcauccagcaccucacggugaccgaggagaucgccgucaagaacuggcuggugcgcgugggccgggagcgccugucccggauggccaucagcggcgacgacugcgucgugaagccccucgacgaccgcuucgcguccgcccugaccgcccugaacgacauggggaaggugcggaaggacauccagcagugggagccgagccgcggcuggaacgacuggacccagguccccuucugcucccaccacuuccacgagcucaucaugaaggacgggcgggugcuggugguccccugccgcaaccaggacgagcugaucggccgggcccgcaucagccagggggccggcuggucccuccgggagacggcgugccugggcaagagcuacgcccagauguggucccugauguacuuccaccgccgggaccuccgccuggccgccaacgccaucugcagcgcggugcccucccacugggugccgaccagccggaccaccugguccauccacgccacccacgaguggaugacgaccgaggacaugcugaccgucuggaaccgcguguggauccaggagaaccccuggauggaggacaagacccccguggagagcugggaggagauccccuaccucgggaagcgggaggaccaguggugcggcagccugaucgggcugacgucccgcgccaccugggccaagaacauccagaccgcgaucaaccagguccggagccucaucggcaacgaggaguacaccgacuacaugccguccaugaagcgcuuccgccgggaggaggaggaggccggggugcugugguga

SEQ ID NO: 9801 - RNA, 9876 nt, Artificial Sequence
  derived and/or modified CDS sequence (opt1) from DENV-2__AF169678__SS-prME
agcgcgggcaugaucaucaugcugauccccaccgugauggccuuccaccucaccacccggaacggggagccccacaugaucgucagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcuccgucgcccuggugccccacgugggcauggggcucgagacccggaccgagaccuggaugagcuccgagggcgccuggaagcacgcccagcgcaucgagaccuggauccugcggcaccccggguucaccaucauggccgcgauccuggccuacaccaucggcaccacccacuuccagcgcgcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugcccgacccagggggagcccagccugaaggaggagcaggacaagcgguucgucugcaagcacuccaugguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugacguucaagaacccccacgcgaagaagcaggacgucgugguccucggcagccaggagggggccaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggugaaggagaucgccgagacccagcacggcaccaucgucauccgggugcaguacgagggggacggcucccccugcaagauccccuucgagaucauggaccuggagaagcgcuacgugcucggccggcugaucacggucaacccgaucgugaccgagaaggacagccccgugaacaucgaggcggagccgcccuucggggacuccuacaucaucaucggcgucgagccggggcagcugaagcucaacugguucaagaagggcagcuccaucgggcagauguucgagaccaccaugcgcggcgccaagcgcauggccauccugggcgacacggccugggacuucgggagccugggcgggguguucaccuccaucggcaaggcccuccaccagguguucggggcgaucuacggcgccgccuucagcggcgucuccuggaccaugaagauccugaucggggugaucaucaccuggaucggcaugaacagccgguccacgagccuguccgugagccugguccucguggggaucgugacccuguaccugggcgucauggugcaggccgacuccgggugcguggucagcuggaagaacaaggagcucaagugcggcagcggcaucuucaucaccgacaacgugcacaccuggacggagcaguacaaguuccagcccgagucccccagcaagcuggcguccgccauccagaaggcccaggaggaggggaucugcggcauccgcagcgugacccggcuggagaaccucauguggaagcagaucacccccgagcugaaccacauccuggccgagaacgaggucaagcucaccaucaugacgggggacaucaagggcaucaugcaggccgggaagcgcucccugcggccgcagcccaccgagcugaaguacagcuggaagaccuggggcaaggcgaagaugcucuccaccgagagccacaaccagacguuccugaucgacggccccgagaccgccgagugcccgaacaccaaccgcgccuggaacucccuggagguggaggacuacggguucggcguguucaccacgaacaucuggcucaagcugaaggagaagcaggacgccuucugcgacagcaagcugauguccgccgcgaucaaggacaaccgggccguccacgccgacaugggguacuggaucgagagcgcccucaacgacaccuggaagaucgagaaggccuccuucaucgaggugaagaacugccacuggcccaagagccacacccugugguccaacggcgugcuggagagcgagaugaucauccccaagaaccucgcgggccccgucucccagcacaacuaccgcccgggguaccacacccagaucgccggccccuggcaccuggggaagcuggagauggacuucgacuucugcgacggcaccacggugguggucaccgaggacugcgggaaccggggccccagccuccgcaccaccacggccagcggcaagcugaucaccgaguggugcugccgguccugcacccugcccccgcuccgcuaccgcggggaggacggcugcugguacgggauggagauccgcccccugaaggagaaggaggagaaccuggugaacagccucgugaccgccggccacgggcaggucgacaacuucucccugggcgugcugggcauggcccucuuccuggaggagaugcugcggacgcgcguggggaccaagcacgccauccuccuggucgccgugagcuucgugacccugaucaccggcaacauguccuucaaggaccucgggcgggucguggugauggucggcgccacgaugaccgacgacaucgggaugggcgugaccuaccuggcccugcucgcggccuucaaggugcgccccaccuucgccgccggccugcugcuccggaagcugacgagcaaggagcugaugaugaccaccaucgggaucguccuccugucccagagcaccauccccgagacgauccuggagcucaccgacgcccuggcgcugggcaugauggugcucaagaucgugcgcaacauggagaaguaccagcuggccgucaccaucauggccauccugugcgugccgaacgccgucauccuccagaacgccuggaagguguccugcaccauccuggcgguggucagcgugagcccccugauccucacgagcucccagcagaagaccgacuggaucccccuggcccugaccaucaaggggcucaaccccaccgccaucuuccugacgacccugagccgcaccaacaagaagcgguccuggccgcucaacgaggccaucauggcggugggcauggucagcauccuggccuccagccugcucaagaacgacauccccaugaccggcccccugguggccgggggccugcucacggugugcuacguccugaccgggcgcuccgccgaccuggagcucgagcgggccgcggacgugaagugggaggaccaggccgagaucagcggcagcucccccauccugagcaucaccaucuccgaggacgggagcauguccaucaagaacgaggaggaggagcagacccugacgauccucauccgcaccggccugcuggugaucagcggccucuucccggucuccauccccaucaccgccgccgccugguaccugugggaggugaagaagcagcgggcgggggugcugugggacguccccuccccgccgcccaugggcaaggccgagcucgaggacggggccuaccgcaucaagcagaagggcauccugggguacucccagaucggcgccggcguguacaaggaggggaccuuccacaccauguggcacgugacgcggggcgccguccugaugcacaaggggaagcgcaucgagcccagcugggcggacgugaagaaggaccucaucuccuacggcgggggcuggaagcuggagggcgaguggaaggagggggaggaggugcagguccuggcccucgagcccggcaagaacccccgggccgugcagaccaagcccgggcuguucaagaccaacaccggcacgaucggggccgugagccuggacuucucccccggcaccagcggcucccccaucaucgacaagaaggggaaggucgugggccucuacgggaacggcguggucacccgcagcggcgccuacguguccgcgaucgcccagaccgagaaguccaucgaggacaaccccgagaucgaggacgacaucuuccggaagaagcgccugacgaucauggaccugcaccccggggccggcaagaccaagcgguaccugcccgccaucgugcgcgaggcgaucaagcgggggcuccgcacccugauccuggccccgacccgggucguggccgccgagauggaggaggcccuccgcggccugcccauccgguaccagacgcccgcgauccgcgccgagcacaccgggcgggagaucguggaccugaugugccacgccaccuucaccaugcgccuccugucccccguccgcgugccgaacuacaaccugaucaucauggacgaggcccacuucacggaccccgccagcaucgcggcccggggcuacaucagcacccgcguggagaugggcgaggccgccgggaucuucaugaccgccacgccgcccggcucccgggacccguucccccagagcaacgcgcccaucaucgacgaggagcgcgagauccccgagcgguccuggaacagcgggcacgagugggucacggacuucaagggcaagaccgugugguucgugccguccaucaaggccgggaacgacaucgccgccugccuccgcaagaacggcaagaaggucauccagcugagccggaagaccuucgacuccgaguacgugaagacccgcacgaacgacugggacuucguggucaccaccgacaucagcgagaugggcgcgaacuucaaggccgagcgggugaucgacccccgccggugcaugaagcccgugauccugaccgacggggaggagcgcgucauccucgccggccccaugccggugacgcacuccagcgccgcccagcggcgcgggcggaucggccgcaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgggagaagguggacgccaucgacggcgaguaccgccugcgcggggaggcccgcaagaccuucgucgaccugaugcgccggggcgaccuccccguguggcuggccuacaagguggcggccgaggggaucaacuacgccgaccgccgguggugcuucgacggcauccagaacaaccagauccuggaggagaacgucgagguggagaucuggaccaaggagggggagcgcaagaagcucaagccgcgguggcuggacgcccgcaucuacagcgacccccuggcccucaaggaguucaaggaguucgcggccggccggaagucccugacgcugaaccucaucaccgagaugggccgccugcccaccuucaugacccagaaggcccgggacgcccuggacaaccucgcgguccugcacacggccgaggccgggggccgcgccuacaaccacgcccugagcgagcuccccgagacccuggagacccugcuccugcugacccuccuggcgacggugaccgggggcaucuuccuguuccucauguccggccgggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugacguacgucgugaucgcgauccucaccguggucgccgccaccauggccaacgagaugggcuuccuggagaagaccaagaaggaccugggguucggcagcaucgccacgcagcagccggaguccaacauccucgacaucgaccugcggcccgcgagcgccuggacccuguacgccguggccaccaccuucgugacgcccaugcuccgccacagcaucgagaacuccagcgucaacgugucccugaccgccaucgcgaaccaggccaccgugcugaugggccucgggaagggcuggccccugagcaagauggacaucggggucccgcugcucgccaucggcugcuacucccaggugaaccccaucacccugacggccgcgcugcuccugcugguggcccacuacgccaucaucgggcccggccuccaggccaaggccacccgggaggcgcagaagcgcgccgccgccggcaucaugaagaaccccaccgucgacgggaucaccgugaucgaccuggacccgauccccuacgaccccaaguucgagaagcagcugggccaggugaugcuccugguccugugcgugacccaggugcucaugaugcggaccaccugggcccugugcgaggcgcugacccucgccacggggcccaucagcacccugugggagggcaacccggggcgcuucuggaacaccaccaucgccgucuccauggccaacaucuuccggggcagcuaccuggccggcgcggggcuccuguucuccaucaugaagaacacgaccaacacccgccggggcaccgggaacaucggcgagacgcugggcgagaaguggaagucccgccucaacgcccuggggaaguccgaguuccagaucuacaagaaguccggcauccaggagguggaccgcacccuggccaaggaggggaucaagcggggcgagaccgaccaccacgccgugucccgcgggagcgcgaagcuccggugguucgucgagcgcaacaugaucacccccgagggcaaggugguggaccugggcugcgggcggggcgggugguccuacuacugcggcgggcugaagaacguccgcgaggugaagggccucacgaagggcgggcccggccacgaggagcccaucccgaugagcaccuacggguggaaccuggugcggcugcaguccggcgucgacguguucuucacgccgcccgagaagugcgacacccuccugugcgacaucggggagagcucccccaacccgacgguggaggccggccgcacccugcggguccucaaccugguggagaacuggcugaacaacaacacccaguucugcaucaaggugcucaaccccuacaugcccagcgucaucgagaagauggaggcccugcagcgcaaguacggcggggcccuggugcggaacccgcugagccgcaacuccacccacgagauguacugggugagcaacgccuccggcaacaucgucagcuccgugaacaugaucagccggaugcucaucaaccgcuucaccaugaagcacaagaaggcgacguacgagcccgacguggaccugggguccggcacccggaacaucgggaucgagagcgagguccccaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgugguccggcuccugaccaagccgugggacgugcugcccaccgugacgcagauggccaugaccgacaccacccccuucgggcagcagcgcgucuucaaggagaagguggacacgcggacccaggagcccaaggagggcaccaagaagcucaugaagaucaccgccgaguggcuguggaaggagcugggcaagaagaagacgccgcgcaugugcacccgcgaggaguucacccggaaggugcgcagcaacgcggcccucggggccaucuucaccgacgagaacaaguggaaguccgcccgggaggccgucgaggacagccgcuucugggagcugguggacaaggagcggaaccugcaccucgagggcaagugcgagacgugcgucuacaacaugauggggaagcgcgagaagaagcugggcgaguucgggaaggcgaagggcucccgggccaucugguacauguggcugggcgcccgcuuccucgaguucgaggcccugggguuccugaacgaggaccacugguucagccgggagaacucccucagcggcguggagggggagggccugcacaagcugggguacauccuccgcgacgugagcaagaaggagggcggcgcgauguacgccgacgacaccgccgggugggacacccggaucacccuggaggaccugaagaacgaggagauggucacgaaccacauggagggcgagcacaagaagcucgccgaggccaucuucaagcugaccuaccagaacaagguggugcgcguccagcggcccacgccccgggggaccgugauggacaucaucucccggcgcgaccagcggggcagcggccagguggggacguacggccugaacaccuucaccaacauggaggcgcagcucauccgccagauggagggggagggcgucuucaagaacauccagcaccugaccgccacggaggagaucgccgugcagaacuggcuggcccggguggggcgcgagcggcucucccgcauggccaucagcggcgacgacugcgucgugaagccccuggacgaccgcuucgcguccgcccugaccgcccucaacgacaugggcaaggugcggaaggacauccagcagugggagccgagccgcggguggaacgacuggacccagguccccuucugcucccaccacuuccacgagcugaucaugaaggacggccgggugcuggugguccccugccgcaaccaggacgagcucaucgggcgggcccgcaucagccagggcgccggguggucccugcgggagaccgcgugccugggcaagagcuacgcccagauguggucccucauguacuuccaccgccgggaccugcgccuggccgccaacgccaucugcagcgcggugcccucccacugggugccgacgagccggaccaccugguccauccacgccaagcacgaguggaugaccaccgaggacaugcucacggucuggaaccgcguguggauccaggagaaccccuggauggaggacaagacccccguggagagcugggaggagauccccuaccugggcaagcgggaggaccaguggugcgggucccugaucggccucaccagccgcgccaccugggccaagaacauccaggcggccaucaaccagguccggagccugaucgggaacgaggaguacacggacuacaugccguccaugaagcgcuuccggcgcgaggaggaggaggccggcgugcugugguga

SEQ ID NO: 9802 - RNA, 9876 nt, Artificial Sequence
  derived and/or modified CDS sequence (opt1) from DENV-2__AF169679__SS-prME
agcgcgggcaugaucaucaugcugauccccaccgugauggccuuccaccucaccacccgcaacggggagccccacaugaucgucagcauccaggagaagggcaagagccugcuguucaagaccgaggacggggugaacaugugcacccucauggcgauggaccugggcgagcugugcgaggacaccaucaccuacaagugcccccuccugcggcagaacgagcccgaggacaucgacugcuggugcaacagcaccagcaccugggugaccuacgggaccugcaccaccaccggcgagcaccgccgggagaagcgcuccgucgcccuggugccccacgugggcauggggcucgagacccggaccgagaccuggaugagcuccgagggcgccuggaagcacgcccagcgcaucgagaccuggauccugcggcaccccggguucaccaucauggccgcgauccuggccuacaccaucggcaccacccacuuccagcgcgcccucaucuucauccugcugacggccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugcccgacccagggggagcccagccugaaggaggagcaggacaagcgguucgucugcaagcacuccaugguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugacguucaagaacccccacgcgaagaagcaggacgucgugguccucggcagccaggagggggccaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggugaaggagaucgccgagacccagcacggcaccaucgucauccgggugcaguacgagggggacggcucccccugcaagauccccuucgagaucauggaccuggagaagcgcuacgugcucggccggcugaucacggucaacccgaucgugaccgagaaggacagccccgugaacaucgaggcggagccgcccuucggggacuccuacaucaucaucggcgucgagccggggcagcugaagcucaacugguucaagaagggcagcuccaucgggcagauguucgagaccaccaugcgcggcgccaagcgcauggccauccugggcgacacggccugggacuucgggagccugggcgggguguucaccuccaucggcaaggcccuccaccagguguucggggcgaucuacggcgccgccuucagcggcgucuccuggaccaugaagauccugaucggggugaucaucaccuggaucggcaugaacagccgguccacgagccuguccgugagccugguccucguggggaucgugacccuguaccugggcgucauggugcaggccgacuccgggugcguggucagcuggaagaacaaggagcucaagugcggcagcggcaucuucaucaccgacaacgugcacaccuggacggagcaguacaaguuccagcccgagucccccagcaagcuggcguccgccauccagaaggcccaggaggaggggaucugcggcauccgcagcgugacccggcuggagaaccucauguggaagcagaucacccccgagcugaaccacauccuggccgagaacgaggucaagcucaccaucaugacgggggacaucaagggcaucaugcaggccgggaagcgcucccugcggccgcagcccaccgagcugaaguacagcuggaagaccuggggcaaggcgaagaugcucuccaccgagagccacaaccagacguuccugaucgacggccccaagaccgccgagugcccgaacaccaaccgcgccuggaacucccuggagguggaggacuacggguucggcguguucaccacgaacaucuggcucaagcugaaggagaagcaggacgccuucugcgacagcaagcugauguccgccgcgaucaaggacaaccgggccguccacgccgacaugggguacuggaucgagagcgcccucaacgacaccuggaagaucgagaaggccuccuucaucgaggugaagaacugccacuggcccaagagccacacccugugguccaacggcgugcuggagagcgagaugaucauccccaagaaccucgcgggccccgucucccagcacaacuaccgcccgggguaccacacccagaucgccggccccuggcaccuggggaagcuggagauggacuucgacuucugcgacggcaccacggugguggucaccgaggacugcgggaaccggggccccagccuccgcaccaccacggccagcggcaagcugaucaccgaguggugcugccgguccugcacccugcccccgcuccgcuaccgcggggaggacggcugcugguacgggauggagauccgcccccugaaggagaaggaggagaaccuggugaacagccucgugaccgccggccacgggcaggucgacaacuucucccugggcgugcugggcauggcccucuuccuggaggagaugcugcggacgcgcguggggaccaagcacgccauccuccuggucgccgugagcuucgugacccugaucaccggcaacauguccuucaaggaccucgggcgggucguggugauggucggcgccacgaugaccgacgacaucgggaugggcgugaccuaccuggcccugcucgcggccuucaaggugcgccccaccuucgccgccggccugcugcuccggaagcugacgagcaaggagcugaugaugaccaccaucgggaucguccuccugucccagagcaccauccccgagacgauccuggagcucaccgacgcccuggcgcugggcaugauggugcucaagaucgugcgcaacauggagaaguaccagcuggccgucaccaucauggccauccugugcgugccgaacgccgucauccuccagaacgccuggaagguguccugcaccauccuggcgguggucagcgugagcccccugauccucacgagcucccagcagaagaccgacuggaucccccuggcccugaccaucaaggggcucaaccccaccgccaucuuccugacgacccugagccgcaccaacaagaagcgguccuggccgcucaacgaggccaucauggcggugggcauggucagcauccuggccuccagccugcucaagaacgacauccccaugaccggcccccugguggccgggggccugcucacggugugcuacguccugaccgggcgcuccgccgaccuggagcucgagcgggccgcggacgugaagugggaggaccaggccgagaucagcggcagcucccccauccugagcaucaccaucuccgaggacgggagcauguccaucaagaacgaggaggaggagcagacccugacgauccucauccgcaccggccugcuggugaucagcggccucuucccggucuccauccccaucaccgccgccgccugguaccugugggaggugaagaagcagcgggcgggggugcugugggacguccccuccccgccgcccaugggcaaggccgagcucgaggacggggccuaccgcaucaagcagaagggcauccugggguacucccagaucggcgccggcguguacaaggaggggaccuuccacaccauguggcacgugacgcggggcgccguccugaugcacaaggggaagcgcaucgagcccagcugggcggacgugaagaaggaccucaucuccuacggcgggggcuggaagcuggagggcgaguggaaggagggggaggaggugcagguccuggcccucgagcccggcaagaacccccgggccgugcagaccaagcccgggcuguucaagaccaacaccggcacgaucggggccgugagccuggacuucucccccggcaccagcggcucccccaucaucgacaagaaggggaaggucgugggccucuacgggaacggcguggucacccgcagcggcgccuacguguccgcgaucgcccagaccgagaaguccaucgaggacaaccccgagaucgaggacgacaucuuccggaagcgccggcugacgaucauggaccugcaccccggggccggcaagaccaagcgcuaccugcccgccaucgugcgggaggcgaucaagcgcgggcuccggacccugauccuggccccgacccgcgucguggccgccgagauggaggaggcccuccggggccugcccauccgcuaccagacgcccgcgauccgggccgagcacaccgggcgcgagaucguggaccugaugugccacgccaccuucaccaugcgccuccugucccccguccgggugccgaacuacaaccugaucaucauggacgaggcccacuucacggaccccgccagcaucgcggcccgcggcuacaucagcacccggguggagaugggcgaggccgccgggaucuucaugaccgccacgccgcccggcucccgcgacccguucccccagagcaacgcgcccaucauggacgaggagcgggagauccccgagcgcuccuggaacagcgggcacgagugggucacggacuucaagggcaagaccgugugguucgugccguccaucaaggccgggaacgacaucgccgccugccuccggaagaacggcaagaaggucauccagcugagccgcaagaccuucgacuccgaguacgugaagacccggacgaacgacugggacuucguggucaccaccgacaucagcgagaugggcgcgaacuucaaggccgagcgcgugaucgacccccggcgcugcaugaagcccgugauccugaccgacggggaggagcgggucauccucgccggccccaugccggugacgcacuccagcgccgcccagcgccgggggcgcaucggccggaaccccaagaacgagaacgaccaguacaucuacaugggggagccccuggagaacgacgaggacugcgcgcacuggaaggaggccaagaugcugcucgacaacaucaacacccccgagggcaucaucccguccauguucgagcccgagcgcgagaagguggacgccaucgacggcgaguaccggcugcgcggggaggcccgcaagaccuucgucgaccugaugcggcgcggcgaccuccccguguggcuggccuacaagguggcggccgaggggaucaacuacgccgaccggcgcuggugcuucgacggcauccggaacaaccagauccuggaggagaacgucgagguggagaucuggaccaaggagggggagcgcaagaagcucaagccgcgguggcuggacgcccgcaucuacagcgacccccuggcccucaaggaguucaaggaguucgcggccggccggaagucccugacgcugaaccucaucaccgagaugggccgccugcccaccuucaugacccagaaggcccgggacgcccuggacaaccucgcgguccugcacacggccgaggccgggggccgcgccuacaaccacgcccugagcgagcuccccgagacccuggagacccugcuccugcugacccuccuggcgacggugaccgggggcaucuuccuguuccucauguccggccgggggaucggcaagaugacccuggggaugugcugcaucaucaccgccagcauccugcucugguacgcccagauccagccgcacuggaucgccgccuccaucauccuggaguucuuccugaucgugcuccugauccccgagcccgagaagcagcgcacgccccaggacaaccagcugacguacgucgugaucgcgauccucaccguggucgccgccaccauggccaacgagaugggcuuccuggagaagaccaagaaggaccugggguucggcagcaucgccacgcagcagccggaguccaacauccucgacaucgaccugcggcccgcgagcgccuggacccuguacgccguggccaccaccuucgugacgcccaugcuccgccacagcaucgagaacuccagcgucaacgugucccugaccgccaucgcgaaccaggccaccgugcugaugggccucgggaagggcuggccccugagcaagauggacaucggggucccgcugcucgccaucggcugcuacucccaggugaaccccaucacccugacggccgcgcugcuccugcugguggcccacuacgccaucaucgggcccggccuccaggccaaggccacccgggaggcgcagaagcgcgccgccgccggcaucaugaagaaccccaccgucgacgggaucaccgugaucgaccuggacccgauccccuacgaccccaaguucgagaagcagcugggccaggugaugcuccugguccugugcgugacccaggugcucaugaugcggaccaccugggcccugugcgaggcgcugacccucgccacggggcccaucagcacccugugggagggcaacccggggcgcuucuggaacaccaccaucgccgucuccauggccaacaucuuccggggcagcuaccuggccggcgcggggcuccuguucuccaucaugaagaacacgaccaacacccgccgcggcaccgggaacaucggcgagacgcugggcgagaaguggaagucccggcucaacgcccuggggaaguccgaguuccagaucuacaagaaguccggcauccaggagguggaccgcacccuggccaaggaggggaucaagcggggcgagaccgaccaccacgccgugucccgcgggagcgcgaagcuccggugguucgucgagcgcaacaugaucacccccgagggcaaggugguggaccugggcugcgggcggggcgggugguccuacuacugcggcgggcugaagaacguccgcgaggugaagggccucacgaagggcgggcccggccacgaggagcccaucccgaugagcaccuacggguggaaccuggugcggcugcaguccggcgucgacguguucuucacgccgcccgagaagugcgacacccuccugugcgacaucggggagagcucccccaacccgacgguggaggccggccgcacccugcggguccucaaccugguggagaacuggcugaacaacaacacccaguucugcaucaaggugcucaaccccuacaugcccagcgucaucgagaagauggaggcccugcagcgcaaguacggcggggcccuggugcggaacccgcugagccgcaacuccacccacgagauguacugggugagcaacgccuccggcaacaucgucagcuccgugaacaugaucagccggaugcucaucaaccgcuucaccaugaagcacaagaaggcgacguacgagcccgacguggaccugggguccggcacccggaacaucgggaucgagagcgagguccccaaccuggacaucaucggcaagcgcaucgagaagaucaagcaggagcacgagaccuccuggcacuacgaccaggaccaccccuacaagaccugggccuaccacggcagcuacgagacgaagcagaccggguccgccagcuccauggugaacggcgugguccggcuccugaccaagccgugggacgugcugcccaccgugacgcagauggccaugaccgacaccacccccuucgggcagcagcgcgucuucaaggagaagguggacacgcgcacccaggagcccaaggagggcaccaagaagcucaugaagaucaccgccgaguggcuguggaaggagcugggcaagaagaagacgccgcggaugugcacccgcgaggaguucacccggaaggugcgcagcaacgcggcccucggggccaucuucaccgacgagaacaaguggaaguccgcccgggaggccgucgaggacagccgcuucugggagcugguggacaaggagcggaaccugcaccucgagggcaagugcgagacgugcgucuacaacaugauggggaagcgcgagaagaagcugggcgaguucgggaaggcgaagggcucccgggccaucugguacauguggcugggcgcccgcuuccucgaguucgaggcccugggguuccugaacgaggaccacugguucagccgggagaacucccucagcggcguggagggggagggccugcacaagcugggguacauccuccgcgacgugagcaagaaggagggcggcgcgauguacgccgacgacaccgccgggugggacacccggaucacccuggaggaccugaagaacgaggagauggucacgaaccacauggagggcgagcacaagaagcucgccgaggccaucuucaagcugaccuaccagaacaagguggugcgcguccagcggcccacgccccgggggaccgugauggacaucaucucccggcgcgaccagcggggcagcggccagguggggacguacggccugaacaccuucaccaacauggaggcgcagcucauccgccagauggagggggagggcgucuucaagaacauccagcaccugaccgccacggaggagaucgccgugcagaacuggcuggcccggguggggcgcgagcgccucucccggauggccaucagcggcgacgacugcgucgugaagccccuggacgaccgcuucgcguccgcccugaccgcccucaacgacaugggcaaggugcggaaggacauccagcagugggagccgagccgcggguggaacgacuggacccagguccccuucugcucccaccacuuccacgagcugaucaugaaggacggccgggugcuggugguccccugccgcaaccaggacgagcucaucgggcgggcccgcaucagccagggcgccggguggucccugcgggagaccgcgugccugggcaagagcuacgcccagauguggucccucauguacuuccaccgccgggaccugcgccuggccgccaacgccaucugcagcgcggugcccucccacugggugccgacgagccggaccaccugguccauccacgccaagcacgaguggaugaccaccgaggacaugcucacggucuggaaccgcguguggauccaggagaaccccuggauggaggacaagacccccguggagagcugggaggagauccccuaccugggcaagcgggaggaccaguggugcgggucccugaucggccucaccagccgcgccaccugggccaagaacauccaggcggccaucaaccagguccggagccugaucgggaacgaggaguacacggacuacaugccguccaugaagcgcuuccggcgcgaggaggaggaggccggcgugcugugguga

SEQ ID NO: 9803 - RNA, 9876 nt, Artificial Sequence
  derived and/or modified CDS sequence (opt1) from DENV-2__AF169680__SS-prME
agcgcggggaugaucaucaugcugauccccaccgugauggccuuccaccucaccacccgcaacggggagccccacaugaucgucagcauccaggagaagggcaagagccugcuguucaagaccgaggacggggugaacaugugcacccucauggcgauggaccugggggagcugugcgaggacaccaucaccuacaagugcccccuccugcggcagaacgagcccgaggacaucgacugcuggugcaacuccaccagcaccugggugaccuacgggaccugcaccaccaccggcgagcaccgccgggagaagcgcuccgucgcccuggugccccacgugggcauggggcucgagacccggaccgagaccuggaugagcuccgagggcgccuggaagcacgcccagcgcaucgagaccuggauccugcggcaccccggguucaccaucauggccgcgauccuggccuacaccaucggcaccacccacuuccagcgcgcccucaucuucauccugcugaccgccgucgcgcccagcaugaccaugcggugcaucgggaucuccaaccgcgacuucguggagggcgugagcggcggguccugggucgacaucgugcucgagcacggcagcugcgugaccaccauggccaagaacaagcccacgcuggacuucgagcugaucaagaccgaggccaagcagcccgccacccuccggaaguacugcaucgaggccaagcugaccaacacgaccaccgagucccgcugcccgacccagggggagcccagccugaaggaggagcaggacaagcgguucgucugcaagcacuccaugguggaccgcggcuggggcaacgggugcggccucuucgggaagggcgggaucgugacgugcgcgauguucacgugcaagaagaacauggagggcaagaucguccagcccgagaaccuggaguacaccaucguggugacgccccacagcggcgaggagcacgccgucgggaacgacacgggcaagcacgggaaggagaucaaggugaccccgcaguccagcaucaccgaggccgagcugaccggcuacgggaccgugacgauggagugcagcccccggaccggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugacguucaagaacccccacgcgaagaagcaggacgucgugguccucggcagccaggagggggccaugcacaccgcccugaccggcgccaccgagauccagauguccagcgggaaccuccuguucacgggccaccugaagugccggcugcgcauggacaagcuccagcugaagggcauguccuacagcaugugcaccgggaaguucaagguggugaaggagaucgccgagacccagcacggcaccaucgucauccgggugcaguacgagggggacggcucccccugcaucauccccuucgagaucauggaccuggagaagcgcuacgugcucggccggcugaucacggucaacccgaucgugaccgagaaggacagccccgugaacaucgaggcggagccgcccuucggggacuccuacaucaucaucggcgucgagccggggcagcugaagcucaacugguucaagaagggcagcuccaucgggcagauguucgagaccaccaugcgcggcgccaagcgcauggccauccugggcgacacggccugggacuucgggagccugggcgggguguucaccuccaucggcaaggcccuccaccagguguucggggcgaucuacggcgccgccuucagcggcgucuccuggaccaugaagauccugaucggggugaucaucaccuggaucggcaugaacagccgguccacgagccuguccgugagccugguccucguggggaucgugacccuguaccugggcgucauggugcaggccgacuccgggugcguggucagcuggaagaacaaggagcucaagugcggcagcggcaucuucaucaccgacaacgugcacaccuggacggagcaguacaaguuccagcccgagucccccagcaagcuggcguccgccauccagaaggcccaggaggaggggaucugcggcauccgcagcgugacccggcuggagaaccucauguggaagcagaucacccccgagcugaaccacauccuggccgagaacgaggucaagcucaccaucaugacgggggacaucaagggcaucaugcaggccgggaagcgcucccugcggccgcagcccaccgagcugaaguacagcuggaagaccuggggcaaggcgaagaugcucuccaccgagagccacaaccagaacuuccugaucgacggccccgagacggccgagugcccgaacaccaaccgcgccuggaacucccuggagguggaggacuacggguucggcguguucaccaccaacgucuggcucaagcugaaggagaagcaggacgccuucugcgacagcaagcugauguccgccgcgaucaaggacaaccgggccgugcacgccgacaugggguacuggaucgagagcgcccucaacgacacguggaagaucgagaaggccuccuucaucgaggugaagaacugccacuggcccaagagccacacccugugguccaacggcguccuggagagcgagaugaucauccccaagaaccucgcgggccccgugucccagcacaacuaccgcccgggguaccacacccagaucgccggccccuggcaccuggggaagcuggagauggacuucgacuucugcgacggcaccaccguggucgugacggaggacugcgggaaccggggccccagccuccgcaccaccaccgccagcggcaagcugaucacggaguggugcugccgguccugcacccugcccccgcuccgcuaccgcggggaggacggcugcugguacgggauggagauccgcccccugaaggagaaggaggagaaccuggugaacagccucgucaccgccggccacggccagguggacaacuucucccugggcgugcugggcauggcccuguuccuggaggagaugcugcggacccgcgucgggacgaagcacgccauccuccugguggccgugagcuucgucacccugaucaccggcaacauguccuucaaggaccucgggcgggugguggucauggugggcgccaccaugacggacgacaucgggaugggcgugaccuaccuggcccugcucgcggccuucaagguccgccccaccuucgccgccggccugcugcuccggaagcugaccagcaaggagcugaugaugacgaccaucgggaucgugcuccugucccagagcaccauccccgagaccauccuggagcucacggacgcccuggcgcugggcaugauggugcucaagaucguccgcaacauggagaaguaccagcuggccgugaccaucauggccauccugugcgucccgaacgccgugauccuccagaacgccuggaagguguccugcaccauccuggcggucgugagcgugagcccccugauccucaccagcucccagcagaagacggacuggaucccccuggcccugaccaucaaggggcucaaccccaccgccaucuuccugaccacgcugagccgcaccaacaagaagcgguccuggccgcucaacgaggccaucauggcggucggcauggugagcauccuggccuccagccugcucaagaacgacauccccaugaccggcccccugguggccgggggccugcucaccgucugcuacgugcugacggggcgcuccgccgaccuggagcucgagcgggccaccgacgugaagugggagcgccaggcggagaucagcggcagcucccccauccugagcaucaccaucuccgaggacgggagcauguccaucaagaacgaggaggaggagcagacccugacgauccucauccggaccggccugcuggucaucagcggccucuucccgguguccauccccaucaccgccgccgccugguaccugugggaggugaagaagcagcgcgccgggguccugugggacgugcccuccccgccgcccaugggcaaggcggagcucgaggacggggccuaccggaucaagcagaagggcauccugggguacucccagaucggcgccggcguguacaaggaggggaccuuccacaccauguggcacgucacgcgcggcgccgugcugaugcacaaggggaagcggaucgagcccagcugggccgacgugaagaaggaccucaucuccuacggcgggggcuggaagcuggagggcgaguggaaggagggggaggagguccaggugcuggcgcucgagcccggcaagaacccccgcgccgugcagaccaagcccgggcuguucaagaccaacaccggcacgaucggggccgucagccuggacuucucccccggcaccagcggcucccccaucaucgacaagaaggggaagguggugggccucuacgggaacggcgucgugacccggagcggcgccuacguguccgccaucgcgcagaccgagaaguccaucgaggacaaccccgagaucgaggacgacaucuuccgcaagcggaagaugacgaucauggaccugcaccccggggccggcaagaccaagcgcuaccugcccgccaucguccgggaggccaucaagcgcgggcugcggacccucauccuggcgccgacccgcgugguggccgccgagauggaggaggcccugcggggccuccccauccgcuaccagacgcccgccauccgggcggagcacaccgggcgcgagaucgucgaccugaugugccacgccaccuucaccaugcgccugcucucccccgugcgggugccgaacuacaaccugaucaucauggacgaggcccacuucacggaccccgccagcaucgccgcgcgcggcuacaucagcacccgggucgagaugggcgaggccgccgggaucuucaugaccgccacgccgcccggcucccgcgacccguucccccagagcaacgcccccaucaucgacgaggagcgggagauccccgagcgcuccuggaacagcgggcacgagugggugacggacuucaagggcaagaccgugugguucgucccguccaucaaggcggggaacgacaucgccgccugccugcggaagaacggcaagaaggugauccagcucagccgcaagaccuucgacuccgaguacgugaagacccggacgaacgacugggacuucgucgugaccaccgacaucagcgagaugggcgccaacuucaaggcggagcgcgugaucgacccccggcgcugcaugaagcccgucauccugaccgacggggaggagcgggugauccuggccggccccaugccggugacgcacuccagcgccgcccagcgccgggggcgcaucggccggaaccccaagaacgagaacgaccaguacaucuacaugggggagccccucgagaacgacgaggacugcgcccacuggaaggaggcgaagaugcugcuggacaacaucaacacccccgagggcaucaucccguccauguucgagcccgagcgcgagaaggucgacgccaucgacggcgaguaccggcuccgcggggaggcccgcaagaccuucguggaccugaugcggcgcggcgaccugcccguguggcucgccuacaaggucgccgcggaggggaucaacuacgccgaccggcgcuggugcuucgacggcauccggaacaaccagauccuggaggagaacguggaggucgagaucuggaccaaggagggggagcgcaagaagcugaagccgcgguggcucgacgcccgcaucuacagcgacccccuggcccugaaggaguucaaggaguucgccgcgggccggaagucccucacgcugaaccugaucaccgagaugggccgccuccccaccuucaugacccagaaggcccgggacgcccuggacaaccuggccgugcuccacacggcggaggccgggggccgcgccuacaaccacgcccugagcgagcugcccgagacccucgagacccugcugcuccugacccugcucgccacggugaccgggggcaucuuccuguuccugauguccggccgggggaucggcaagaugacccucgggaugugcugcaucaucaccgcgagcauccugcugugguacgcccagauccagccgcacuggaucgccgccuccaucauccucgaguucuuccugaucguccugcucauccccgagcccgagaagcagcgcacgccccaggacaaccagcugacguacguggugaucgccauccugaccgucguggcggccaccauggccaacgagaugggcuuccucgagaagaccaagaaggaccugggguucggcagcaucgccacgcagcagccggaguccaacauccuggacaucgaccuccggcccgccagcgcguggacccuguacgccguggccaccaccuucgucacgcccaugcugcgccacagcaucgagaacuccagcgugaacgugucccucaccgccaucgccaaccaggcgaccguccugaugggccuggggaagggcuggccccucagcaagauggacaucggggugccgcugcuggccaucggcugcuacucccaggugaaccccaucacccucacggccgcccugcugcuccuggucgcgcacuacgccaucaucgggcccggccugcaggccaaggccacccgggaggcccagaagcgcgcggccgccggcaucaugaagaaccccagcguggacgggaucaccgugaucgaccucgacccgauccccuacgaccccaaguucgagaagcagcugggccaggucaugcugcucgugcugugcgugacccagguccugaugaugcggacgaccugggcccucugcgaggcccugacccuggcgaccgggcccaucuccacgcucugggagggcaacccggggcgcuucuggaacaccaccaucgccgugagcauggccaacaucuuccggggcuccuaccuggccggcgccgggcuccucuucagcaucaugaagaacaccacgaacacccgccgcggcaccgggaacaucggcgagacccugggcgagaaguggaagucccggcugaacgcgcucggcaagagcgaguuccagaucuacaagaaguccggcauccaggagguggaccgcacgcuggccaaggaggggaucaagcggggcgagaccgaccaccacaccgucagccgcggguccgccaagcugcggugguucguggagcgcaacaugaucacccccgagggcaaggugcucgaccugggcugcgggcggggcggguggagcuacuacugcggcgggcugaagaacguccgcgaggugaagggccucacgaagggcgggcccggccacgaggagcccaucccgauguccaccuacggguggaaccuggugcggcugcagagcggcgucgacguguucuucacgccgcccgagaagugcgacacccuccugugcgacaucggggaguccagccccaacccgacgguggaggccggccgcacccugcggguccucaaccugguggagaacuggcugaacaacaacacccaguucugcaucaaggugcucaaccccuacaugcccagcgucaucgagaagauggaggcgcugcagcgcaaguacggcggggcccuggugcggaacccgcugucccgcaacagcacccacgagauguacuggguguccaacgccagcggcaacaucgucuccagcgugaacaugaucucccggaugcucaucaaccgcuucaccaugaagcacaagaaggccacguacgagcccgacguggaccuggggagcggcacccggaacaucgggaucgaguccgagguccccaaccuggacaucaucggcaagcgcaucgagaagaucaagcaggagcacgagaccagcuggcacuacgaccaggaccaccccuacaagaccugggccuaccacggcuccuacgagacgaagcagaccgggagcgcguccagcauggugaacggcgugguccggcuccugaccaagccgugggacgugcugcccaccgugacgcagauggccaugaccgacaccacccccuucgggcagcagcgcgucuucaaggagaagguggacacgcgcacccaggagcccaaggagggcaccaagaagcucaugaagaucaccgccgaguggcuguggaaggagcugggcaagaagaagacgccgcggaugugcacccgcgaggaguucacccggaaggugcgcuccaacgccgcccucggggcgaucuucaccgacgagaacaaguggaaguccgcccgggaggccgucgaggacucccgcuucugggagcugguggacaaggagcggaaccugcaccucgagggcaagugcgagacgugcgucuacaacaugauggggaagcgcgagaagaagcugggcgaguucgggaaggccaagggcagccgggccaucugguacauguggcugggcgcgcgcuuccucgaguucgaggcccugggguuccugaacgaggaccacugguucucccgggagaacagccucagcggcguggagggggagggccugcacaagcugggguacauccuccgcgacguguccaagaaggagggcggcgccauguacgccgacgacaccgcggggugggacacccggaucacccuggaggaccugaagaacgaggagauggucacgaaccacauggagggcgagcacaagaagcucgccgaggccaucuucaagcugaccuaccagaacaagguggugcgcguccagcggcccacgccccgggggaccgugauggacaucaucagccggcgcgaccagcggggcuccggccagguggggacguacggccugaacaccuucaccaacauggaggcccagcucauccgccagauggagggggagggcgucuucaagaacauccagcaccugaccgccacggaggagaucgcggugcagaacuggcuggcccggguggggcgcgagcgccucagccggauggccaucuccggcgacgacugcgucgugaagccccuggacgaccgcuucgccagcgcccugaccgcgcucaacgacaugggcaaggugcggaaggacauccagcagugggagccgucccgcggguggaacgacuggacccagguccccuucugcagccaccacuuccacgagcugaucaugaaggacggccgggugcuggugguccccugccgcaaccaggacgagcucaucgggcgggcccgcaucucccagggcgccggguggagccugcgggagaccgccugccugggcaaguccuacgcccagauguggagccucauguacuuccaccgccgggaccugcgccuggcggccaacgccaucugcuccgccgugcccagccacugggugccgacgucccggaccaccuggagcauccacgccaagcacgaguggaugaccaccgaggacaugcucacggucuggaaccgcguguggauccaggagaaccccuggauggaggacaagacccccguggaguccugggaggagauccccuaccugggcaagcgggaggaccaguggugcgggagccugaucggccucaccagccgcgcgaccugggccaagaacauccaggccgccaucaaccagguccggucccugaucgggaacgaggaguacacggacuacaugccgagcaugaagcgcuuccggcgcgaggaggaggaggcgggcgugcugugguga
